(12) United States Patent
Facchini et al.

(10) Patent No.: US 11,613,770 B2
(45) Date of Patent: *Mar. 28, 2023

(54) COMPOSITIONS AND METHODS FOR MAKING (R)-RETICULINE AND PRECURSORS THEREOF

(71) Applicant: Antheia, Inc., Menlo Park, CA (US)

(72) Inventors: Peter James Facchini, Calgary (CA); Scott Cameron Farrow, Calgary (CA); Guillaume Arthur Welch Beaudoin, Calgary (CA)

(73) Assignee: ANTHEIA, INC., Menlo Park, CA (US)

(*) Notice: Subject to any disclaimer, the term of this patent is extended or adjusted under 35 U.S.C. 154(b) by 0 days.

This patent is subject to a terminal disclaimer.

(21) Appl. No.: 16/213,037

(22) Filed: Dec. 7, 2018

(65) Prior Publication Data

US 2019/0241919 A1    Aug. 8, 2019

Related U.S. Application Data

(62) Division of application No. 15/101,474, filed as application No. PCT/CA2014/051164 on Dec. 3, 2014, now Pat. No. 10,190,141.

(60) Provisional application No. 61/911,759, filed on Dec. 4, 2013, provisional application No. 62/050,399, filed on Sep. 15, 2014.

(51) Int. Cl.
| | |
|---|---|
| *C12P 17/12* | (2006.01) |
| *C12N 15/82* | (2006.01) |
| *C12N 9/04* | (2006.01) |
| *A01H 1/06* | (2006.01) |
| *C12N 9/10* | (2006.01) |

(52) U.S. Cl.
CPC ............ *C12P 17/12* (2013.01); *A01H 1/06* (2013.01); *C12N 9/0006* (2013.01); *C12N 9/1085* (2013.01); *C12N 15/8218* (2013.01); *C12N 15/8243* (2013.01); *C12Y 101/01247* (2013.01); *C12Y 205/01059* (2013.01)

(58) Field of Classification Search
CPC ..................................................... C12P 17/12
See application file for complete search history.

(56) References Cited

U.S. PATENT DOCUMENTS

| | | | |
|---|---|---|---|
| 3,785,927 A | 1/1974 | Schoenewaldt | |
| 10,006,010 B2* | 6/2018 | Winzer | C12P 17/12 |
| 10,190,141 B2* | 1/2019 | Facchini | C12P 17/12 |
| 2007/0298481 A1 | 12/2007 | Sato | |
| 2008/0176754 A1 | 7/2008 | Smolke et al. | |
| 2018/0163241 A1 | 6/2018 | Smolke et al. | |

FOREIGN PATENT DOCUMENTS

| | | |
|---|---|---|
| EP | 1837396 A1 | 9/2007 |
| WO | 00/58333 A1 | 10/2000 |
| WO | 2008067070 A2 | 6/2008 |
| WO | 2011058446 A2 | 5/2011 |
| WO | 2015103711 A1 | 7/2015 |
| WO | 2015/173590 A1 | 11/2015 |
| WO | 2015173590 A1 | 11/2015 |
| WO | 2016/183023 | 11/2016 |

OTHER PUBLICATIONS

Allen, R.S. et al., Nature Biotechnology 2004; vol. 22, No. 12, pp. 1559-1566. (Year: 2004).*
Pauli, H.H. et al., T.M., The Plant Journal; 1998, vol. 13, No. 6; pp. 793-801. (Year: 1998).*
Kratzer, R. et al. (2008) Biotechnology & Bioengineering, vol. 101, No. 5, pp. 1094-1101. (Year: 2008).*
Unterlinner, B. et al., The Plant Journal; 1999, vol. 18, No. 5, pp. 465-475. (Year: 1999).*
Hagel et al., Plant and Cell Physiology, 54:647-672 (2013).
Hawkins et al., Nature Chemical Biology, 4:564-573 (2008).
Database EMBL [Online] Jul. 2, 2015 (Jul. 2, 2015),"Papaver somniferum (opium poppy) reticuline epimerase ID—AK060181 ; SV 1 ; linear; genomic DNA; STD; PLN; 2703 BP.", retrieved from EBI accession No. EM_CDS:AKO60181.
Database Geneseq [Online] Apr. 9, 2015 (Apr. 9, 2015),"Papaver somniferum OMT protein, SEQ ID 543.", retrieved from EBI accession No. GSP:BBU80692 Database accession No. BBU80692.
Winzer et al., Science, 336:1704-1708 (2012).
Hagel et al., Nature Chemical Biology, 6:273-275 (2010).
Morris et al., "Plug-and-Play Benzylisoquinoline Alkaloid Biosynthetic Gene Discovery in Engineered Yeast" in Methods in Enzymology,144-178 (Elsevier 2016).
Galanie et al., Science, 349:1095-1100 (2015).
Facchini, P. J., GenBank Accession No. FE967184, Mar. 31, 2008 (Mar. 31, 2008), [online] [retrieved on Sep. 19, 2017.
Supplementary Partial European Search Report issued in EP Application No. 17818778.7.
Extended European Search Report issued in European Patent Application No. 14867017.7 dated May 23, 2017.
Examination Report issued in European Patent Application No. 14867017.7 dated Feb. 5, 2018.
Altschul, S.F. et al., "Basic Local Alignment Search Tool", J. Molec. Biol. 215:403-410 (1990).
Allen, R.S., et al., "RNAi-mediated replacement of morphine with the nonnarcotic alkaloid reticuline in opium poppy", Nature Biotechnology 2004; vol. 22, No. 12, pp. 1559-1566.
Carillo, H. et al., "The Multiple Sequence Alignment Problem in Biology", SIAM J. Applied Math., 48(5):1073-1082 (1988).
De-Eknamkul, W. et al., "Enzymic Formation of (R)-Reticuline From 1,2-Dehydroreticuline in teh Opium Poppy Plant", Tetrahedron Letters, vol. 31, No. 34, p. 4855-4858.

(Continued)

*Primary Examiner* — Russell Kallis
(74) *Attorney, Agent, or Firm* — Mintz, Levin, Cohn, Ferris, Glovsky and Popeo, P.C.

(57) ABSTRACT

Methods that may be used for the manufacture of the chemical compound (R)-Reticuline and synthesis precursors thereof. Compositions useful for the synthesis (R)-Reticuline and synthesis precursors are also provided.

10 Claims, 13 Drawing Sheets

Specification includes a Sequence Listing.

(56) References Cited

OTHER PUBLICATIONS

Desgagne-Penix, I. et al., "Integration of deep transcriptome and proteome analyses reveals the components of alkaloid metabolism in opium poppy cell cultures", BMC Plant Biology, 10(1):1-17 (2010).
Devereux, J. et al., "A comprehensive set of sequence analysis programs for the VAX", Nucleic Acids Res., 12(1):387-395 (1984).
Farrow, S.C. et al., "Dioxygenases Catalyze O-Demethylation and O,O-Demethylenation with Widespread Roles in Benzylisoquinoline Alkaloid Metabolism in Opium Poppy", J. Biol. Chem, 288(40):28997-29012 (2013).
Farrow, S.C. et al., "Stereochemical inversion of (S)-reticuline by a cytochrome P450 fusion in opium poppy", Nature Chemical Biology, 11:728-732 (2015).
Gesell, A. et al. "CYP719B1 is salutaridine synthase, the C_C phenol-coupling enzyme of morphine biosynthesis in opium poppy", The Journal of Biological Chemistry, Sep. 4, 2009, vol. 284, p. 24432-24442, ISSN 0021-9258.
Henikoff, S. et al., "Amino acid substitution matrices from protein blocks", Proc. Natl. Acad. Sci. USA, 89:10915-10919 (1992).
Millgate, A.G. et al., "Morphine-pathway block in top1 poppies", Nature; Sep. 2004, vol. 431, p. 413-414.
Minami, H. et al. "Microbial production of plant benzylisoquinoline alkaloids", PNAS, vol. 105, No. 21, p. 7393-7398, 2008.
Needleman, S.B. et al., "A General Method Applicable to the Search for Similarities in the Amino Acid Sequence of Two Proteins", J. Mol. Biol., 48:443-453 (1970).
Niedz, R.P. et al., "Green fluorescent protein: an in vivo reporter of plant gene expression", Plant Cell Rep., 14:403-406 (1995).
Paterson, A.H., The DNA Revolution, Chapter 2 in: Genome Mapping in Plants; Academic Press/R.G. Landis Company, Austin, TX (1996).
Pauli, H.H. et al., "Molecular cloning and functional heterologous expression of two alleles encoding (S)-N-methylcoclaurine 3'-hydroxylase (CYP80B1), a new methyl jasmonate-inducible cytochrome P-450-dependent mono-oxygenase of benzylisoquinoline alkaloid biosynthesis", The Plant Journal, 1998; vol. 13, No. 6, p. 793-801.
Plant Molecular Biology: A Laboratory Manual, Chapter 7, Clark, Ed., Springer.
Salis, H.M. et al., "Automated Design of Synthetic Ribosome Binding Sites to Precisely Control Protein Expression", Nat Biotechnol. Oct. 2009; 27(10):946-950.
Smith, T.F. et al., "Comparison of Biosequences", Adv. Appl. Math., 2:482-489 (1981).
Teitel, S. et al., "An Improved Synthesis of Various Racemic Polyphenolic Tetrahydroisoquinoline alkaloids", Journal of Heterocyclic Chemistry 5:825-829 (1968).
Thompson, J.D. et al., "Clustal W: Improving the sensitivity of progressive multiple sequence alignment through sequence weighting, position-specific gap penalties and weight matrix choice", Nucleic Acid Res., 22(22):4673-4680 (1994).
Unterlinner, B. et al., "Molecular cloning and functional expression of codeinone reductase: the penultimate enzyme in morphine biosynthesis in the opium poppy *Papaver somniferum*", The Plant Journal, 1999, vol. 18, No. 5, p. 465-475.
Jez et al., Biochem. Pharmacol., 54:639-647 (1997).
Yoshida et al., Chemistry: An Organism, 36: 393-398 (1998).
Imai, Chemistry: An Organism, 36: 530-533 (1998).
U.S. Office Action dated Apr. 23, 2021 in U.S. Appl. No. 16/541,078.
Ba et al., "Semi-rational engineering of cytochrome P450sca-2 in a hybrid system for enhanced catalytic activity: insights into the important role of election transfer", Biotechnology and Bioengineering, 2013, vol. 110(11): 2815-2825. (Year: 2013).
Banerjee et al., "Improving enzymes for biomass converstion: A basic research perspective", Bioenerg. Res., 2010, vol. 3: 82-92. (Year: 2010), DOI: 10.1007/s12155-009-9067-5.
Chica et al., "Semi-rational approaches to engineering enzyme activity: combining the benefits of directed evolution and rational design", Current Opinion in Biotechnology, 2005, vol. 16: 378-384. (Year: 2005), DOI: 10.1016/j.copbio.2005.06.004.
U.S. Final Office Action dated Dec. 28, 2020 in U.S. Appl. No. 16/541,078.
Sen et al., "Developments in directed evolution for enzyme functions", Appl. Biochem. Biotechnol., 2007, vol. 143: 212-223 (Year: 2007), DOI: 10.1007/s12010-007-8003-4.
Kenaan, C et al., "Uncovering the role of hydrophobic residues in Cytochrome P450-Cytochrome P450 reductase Interactions", Biochemistry. May 17, 2011, Epub Apr. 22, 2011, vol. 50, No. 19, pp. 3957-3967, DOI: 10.1021/bi1020748.
Girvan, HM et al., "Applications of microbial cytochrome P450 enzymes in biotechnology and synthetic biology", Current Opinion in Chemical Biology. Apr. 2016, Epub Mar. 22, 2016; vol. 31, pp. 136-145.
U.S. Final Office Action dated Jan. 21, 2021 in U.S. Appl. No. 15/567,358.
Mitchell et al., "Circular Permutation of a synthetic eukaryotic chromosome with the telomerator", PNAS, 2014, 111, 17003-17010.
Vasquez et al., "Genome Organization and Function: A View from Yeast and *Arabidopsis*", Molecular Plant 2010, 3, pp. 678-690.
Devos, D., "Practical Limits of Function Prediction," Proteins: Structure, Function, and Genetics 41:98-107 (2000).
Whisstock, J.; "Prediction of protein function from protein sequence," Quarterly Reviews of Biophysics, Cambridge Univ. Press. Aug. 2003; 36(3): 307-40.
Witkowski, A., "Conversion of B-Ketoacyl Synthase to a Malonyl Decarboxylase by Replacement of the Active-Site Cysteine with Glutamine," Biochemistry 38, 11643-11650 (1999).
U.S. Office Action dated Jun. 5, 2020 in U.S. Appl. No. 15/567,358.
Mishra et al., "Wound Induced Transcriptional Regulation of Benzylisoquinoline Pathway and Characterization of Wound Inducible PsWRKY Transcription Factor from Papaver somniferum", PLoS One, Jan. 30, 2013, vol. 8, Iss. 1, pp. 1-15.
Trenchard et al., "De novo production of the key branch point benzyl isoquinoline alkaloid reticuline in yeast", Metabolic Engineering, Jul. 10, 2015, vol. 31, pp. 74-83.
Hirata et al., "1, 2-Dehydroreticuline synthase, the branch point enzyme opening the morphinan biosynthetic pathway", www.sciencedirect.com, Phytochemistry 65 (2004) 1039-1046.
U.S. Office Action dated Sep. 9, 2019 in U.S. Appl. No. 15/567,358.
U.S. Office Action dated Sep. 17, 2018 in U.S. Appl. No. 15/567,358.
U.S. Office Action dated Jan. 29, 2019 in U.S. Appl. No. 16/149,025.
U.S. Office Action dated Jun. 4, 2020 in U.S. Appl. No. 16/541,078.
U.S. Notice of Allowance dated Jun. 5, 2019 in U.S. Appl. No. 16/149,025.
U.S. Notice of Allowance dated Aug. 27, 2019 in U.S. Appl. No. 16/149,025.
Guo et al., Protein tolerance to random amino acid change. PNASI, 2004, vol. 101 (25): 9205-9210. (Year: 2004).
Kimchi-Sarfaty et al., "A "Silent" polymorphism in the MDR1 gene changes substrate specificity", Science, 2007, vol. 315: 525-528 (Year: 2007).
Nackley et al., "Human Caechol-O-Methyltransferase haplotypes modulate protein expression by altering mRNA secondary structure", Science, 2006, vol. 314: 1930-1933. (Year: 2006).
Sauna et al., "Silent polymorphisms speak: How they affect pharmacogenomics and the treatment of cancer", Cancer Res., 2007, vol. 67(20): 9609-9612. (Year: 2007).
U.S. Office Action dated Jun. 11, 2021 in U.S. Appl. No. 15/567,358.
U.S. Office Action dated Jan. 13, 2022 in U.S. Appl. No. 15/567,358.
U.S. Office Action dated Oct. 18, 2022 in U.S. Appl. No. 15/567,358.
Notice of Allowance dated Dec. 3, 2021 in U.S. Appl. No. 16/541,078.

* cited by examiner

COMPOSITIONS AND METHODS FOR MAKING (R)-RETICULINE AND PRECURSORS THEREOF

RELATED APPLICATIONS

This application is a divisional application of U.S. patent application Ser. No. 15/101,474, filed on Jun. 3, 2016 (now allowed), which is a national phase entry application of Patent Cooperation Treaty Application No. PCT/CA2014/051164 filed Dec. 3, 2014, which claims the benefit under 35 USC § 119(e) from U.S. Provisional Patent Application No. 61/911,759, filed on Dec. 4, 2013 and U.S. Provisional Patent Application No. 62/050,399, filed on Sep. 15, 2014, both all of which are incorporated by reference herein in their entirety.

INCORPORATION OF SEQUENCE LISTING

The instant application contains a Sequence Listing which has been submitted electronically in ASCII format and is hereby incorporated by reference in its entirety. The ASCII copy was created on Dec. 14, 2020, is named 16213037SeqList.txt and is 990,981 bytes in size.

FIELD OF THE DISCLOSURE

The compositions and methods disclosed herein relate to secondary metabolites and processes for manufacturing the same. More particularly, the present disclosure relates to (R)-Reticuline and certain precursors thereof and methods and compositions for manufacturing (R)-Reticuline and such precursors.

BACKGROUND OF THE DISCLOSURE

The following paragraphs are provided by way of background to the present disclosure. They are not however an admission that anything discussed therein is prior art or part of the knowledge of persons skilled in the art.

The biochemical pathways of living organisms are commonly classified as being either part of primary metabolism or part of secondary metabolism. Pathways that are part of a living cell's primary metabolism are involved in catabolism for energy production or in anabolism for building block production for the cell. Secondary metabolites, on the other hand, are produced by living cells without having any obvious anabolic or catabolic function. It has however long been recognized that many secondary metabolites are useful in many respects, including for example as therapeutic agents or natural deterrents.

The secondary metabolite (R)-Reticuline is produced by opium poppy (*Papaver somniferum*) and other members of the plant families Papaveraceae, Lauraceae, Annonaceae, Euphorbiaceae and Moraceae, and may be used as a source material for producing the pharmaceutically active compounds including morphine and codeine.

It is known that (R)-Reticuline in planta is produced from (S)-Reticuline. However it is not clear which genes and polypeptides are involved in catalyzing the conversion reaction(s).

Currently (R)-Reticuline may be harvested from natural sources, such as opium poppy. Alternatively (R)-Reticuline may be prepared synthetically. The existing manufacturing methods for (R)-Reticuline however suffer from low yields of (R)-Reticuline and/or are expensive. No methods exist to biosynthetically make (R)-Reticuline from (S)-reticuline.

There exists therefore in the art a need for improved methods for the synthesis of (R)-Reticuline.

SUMMARY OF THE DISCLOSURE

The following paragraphs are intended to introduce the reader to the more detailed description that follows and not to define or limit the claimed subject matter of the present disclosure.

The present disclosure relates to the secondary metabolite (R)-Reticuline and certain precursors thereof, as well as to methods of making (R)-Reticuline and certain precursors thereof.

Accordingly, the present disclosure provides, in at least one aspect, at least one embodiment of a method of making (R)-Reticuline or a precursor of (R)-Reticuline comprising:
 (a) providing a benzylisoquinoline derivative;
 (b) contacting the benzylisoquinoline derivative with an enzyme mixture capable of converting the benzylisoquinoline derivative to (R)-Reticuline or an (R)-Reticuline precursor under conditions that permit the conversion of the benzylisoquinoline derivative to (R)-Reticuline or an (R)-Reticuline precursor.

The present disclosure further provides in at least one aspect at least one embodiment of a method of making (R)-Reticuline or a precursor thereof comprising:
 (a) providing a benzylisoquinoline derivative;
 (b) contacting the benzylisoquinoline derivative with an enzyme mixture capable of converting the benzylisoquinoline derivative to (R)-Reticuline or an (R)-Reticuline precursor under conditions that permit the conversion of the benzylisoquinoline derivative to (R)-Reticuline or an (R)-Reticuline precursor;
wherein the benzylisoquinoline derivative has the chemical formula (I):

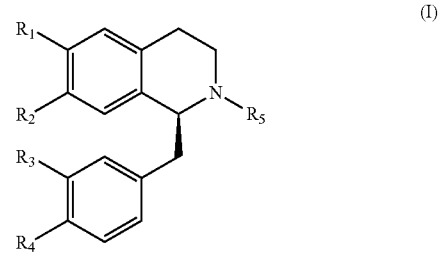

(I)

wherein $R_1$, $R_2$, $R_3$ and $R_4$ each represent a hydrogen atom, a hydroxyl group or a methoxy group;
and wherein $R_5$ represents a hydrogen atom or a methyl group; and
wherein the (R)-Reticuline precursor has the chemical formula (II):

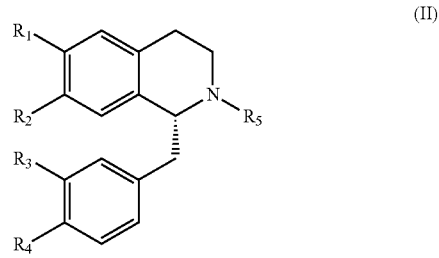

(II)

wherein $R_1$, $R_2$, $R_3$ and $R_4$ each represent a hydrogen atom, a hydroxyl group or a methoxy group;

and wherein $R_5$ represents a hydrogen atom or a methyl group, with the proviso that chemical formula (II) excepts (R)-Reticuline.

In preferred embodiments, in the benzylisoquinoline derivative $R_1$ is a methoxy group; $R_2$ is a hydroxyl group; $R_3$ is a hydroxyl group; $R_4$ is a methoxy group and $R_5$ is a methyl group, providing the chemical formula:

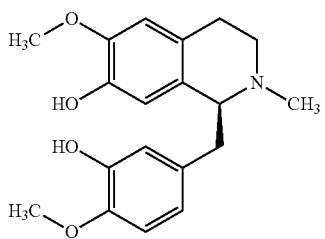

(III)

also known as (S)-Reticuline.

In further preferred embodiments, the enzyme mixture comprises a first polypeptide capable of oxidizing the benzylisoquinoline derivative to form an oxidized benzylisoquinoline derivative having the chemical formula (IV):

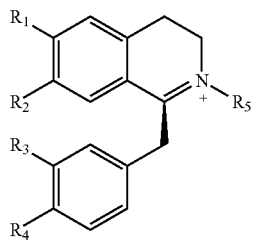

(IV)

wherein $R_1$, $R_2$, $R_3$ and $R_4$ each represent a hydrogen atom, hydroxyl or methoxy group;

and wherein $R_5$ represents a hydrogen atom or a methyl group; and a second polypeptide capable of reducing the oxidized benzylisoquinoline derivative (IV) to form (R)-Reticuline or a (R)-Reticuline precursor having the chemical formula (II):

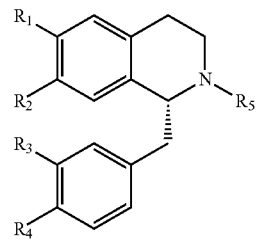

(II)

wherein $R_1$, $R_2$, $R_3$ and $R_4$ each represent a hydrogen atom, a hydroxyl group or a methoxy group;

and wherein $R_5$ represents a hydrogen atom or a methyl group, with the proviso that chemical formula (II) excepts (R)-Reticuline.

In further preferred embodiments, the enzyme mixture comprises a first polypeptide capable of oxidizing (S)-Reticuline to form 1,2-Dehydroreticuline and a second polypeptide capable of reducing 1,2-Dehydroreticuline to form (R)-Reticuline.

In further preferred embodiments, the first polypeptide capable of oxidizing the benzylisoquinoline derivative to form the oxidized benzylisoquinoline derivative is a cytochrome P450 and the second polypeptide capable of reducing the oxidized benzylisoquinoline derivative to form (R)-Reticuline or an (R)-Reticuline precursor is an aldo-keto reductase (AKR).

In accordance with the present disclosure, the methods may be conducted in vitro or in vivo including, but not limited to, in plants, plant cell cultures, microorganisms, and cell-free systems.

Provided herein is further a method for preparing an enzyme selected from the group consisting of CYP450 and AKR, or a mixture thereof comprising:
 (a) providing a chimeric nucleic acid sequence comprising as operably linked components:
  (i) one or more nucleic acid sequences encoding one or more of the polypeptides selected from the group consisting of CYP450 and AKR; and
  (ii) one or more nucleic acid sequences capable of controlling expression in a host cell;
 (b) introducing the chimeric nucleic acid sequence into a host cell and growing the host cell to produce the polypeptide selected from the group consisting of CYP450 and AKR; and
 (c) recovering a polypeptide selected from the group consisting of CYP450 and AKR from the host cell.

Provided herein still further is a method for preparing (R)-Reticuline or an (R)-Reticuline precursor having chemical formula (II) comprising:
 (a) providing a chimeric nucleic acid sequence comprising as operably linked components:
  (i) a first nucleic acid sequence encoding a CYP450 polypeptide;
  (ii) a second nucleic acid sequence encoding an AKR polypeptide; and
  (iii) one or more nucleic acid sequences capable of controlling expression in a host cell;
 (b) introducing the chimeric nucleic acid sequence into a host cell and growing the host cell to produce CYP450 and AKR and to produce (R)-Reticuline or an (R)-Reticuline precursor having chemical formula (II); and
 (c) recovering (R)-Reticuline or an (R)-Reticuline precursor having chemical formula (II).

In preferred embodiments, the first and second nucleic acid sequences are operably linked in order to produce a fusion polypeptide comprising CYP450 and AKR.

There is further provided herein a method for preparing (R)-Reticuline or an (R)-Reticuline precursor having chemical formula (II) comprising:
 (a) providing a first chimeric nucleic acid sequence comprising as operably linked components a first nucleic acid sequence encoding a CYP450 polypeptide and a first nucleic acid sequence controlling expression of the first nucleic acid sequence in the cell;
 (b) providing a second chimeric nucleic acid sequence comprising as operably linked components a second nucleic acid sequence encoding an AKR polypeptide and a second nucleic acid sequence controlling expression of the second nucleic acid sequence in the cell;
 (c) introducing the first and second chimeric nucleic acid sequences into a host cell and growing the host cell to produce CYP450 and AKR and to produce (R)-Reticuline or an (R)-Reticuline precursor having chemical formula (II); and (d) recovering (R)-Reticuline or an (R)-Reticuline precursor having chemical formula (II).

The present disclosure further provides compositions for making (R)-Reticuline, including an enzyme mixture comprising a first polypeptide capable of oxidizing (S)-Reticuline to form 1,2-Dehydroreticuline and a second polypeptide capable of reducing 1,2-Dehydroreticuline to form (R)-Reticuline.

In preferred embodiments, the enzyme mixture comprises a first polypeptide capable of oxidizing (S)-Reticuline to form 1,2-Dehydroreticuline and a second polypeptide capable of reducing 1,2-Dehydroreticuline to form (R)-Reticuline.

In further preferred embodiments, the first polypeptide capable of oxidizing (S)-Reticuline to form 1,2-Dehydroreticuline is a cytochrome P450 and the second polypeptide capable of reducing 1,2-Dehydroreticuline to form (R)-Reticuline is an aldo-keto reductase (AKR).

The present invention still further provides compositions comprising nucleic acid sequences encoding a first polypeptide capable of oxidizing (S)-Reticuline to form 1,2-Dehydroreticuline and a second polypeptide capable of reducing 1,2-Dehydroreticuline to form (R)-Reticuline. In preferred embodiments the nucleic acid sequences are a nucleic acid sequence encoding a cytochrome P450 and an aldo-keto reductase, together capable of oxidizing (S)-Reticuline to form 1,2-Dehydroreticuline and a second polypeptide capable of reducing 1,2-Dehydroreticuline to form (R)-Reticuline.

The present disclosure further includes methods of using nucleic acid sequences encoding AKR and/or CYP450, to detect the presence and absence thereof in samples, for example samples comprising plant cells, to modulate the expression AKR and/or CYP450 in plant cells and other cells, and as a marker to evaluate segregation of a gene genetically linked AKR and/or CYP450 in a plant population.

In a further embodiment, the present disclosure provides a method of detecting the presence or absence of a nucleic acid sequence encoding AKR and/or CYP450 comprising:

(a) providing a sample suspected to comprise a nucleic acid sequence encoding AKR and/or CYP450; and (b) analyzing the sample for the presence of a nucleotide sequence encoding AKR and/or CYP450.

In a further embodiment, the present disclosure provides a method for modulating expression of nucleic acid sequences in a cell naturally expressing AKR and/or CYP450 comprising:

(a) providing a cell naturally expressing AKR and/or CYP450;

(b) mutagenizing the cell;

(c) growing the cell to obtain a plurality of cells; and (d) determining if the plurality of cells comprises a cell comprising modulated levels of AKR and/or CYP450.

In yet a further embodiment, the present disclosure provides a method of reducing the expression of AKR and/or CYP450 in a cell, comprising:

(a) providing a cell expressing AKR and/or CYP450; and (b) silencing expression of AKR and/or CYP450 in the cell.

Other features and advantages of the present disclosure will become apparent from the following detailed description. It should be understood, however, that the detailed description, while indicating preferred implementations of the disclosure, are given by way of illustration only, since various changes and modifications within the spirit and scope of the disclosure will become apparent to those of skill in the art from the detailed description.

BRIEF DESCRIPTION OF THE DRAWINGS

The disclosure is in the hereinafter provided paragraphs described in relation to its Figures. The Figures provided herein are provided for illustration purposes and are not intended to limit the present disclosure.

FIG. 7C) and one region of the COR1.3 gene (FIG. 7B). In each FIG. 7A-7C the different panels represent the following: (Panel A) Fragment (grey box) of the REPI or COR1.3 cDNA used to assemble the pTRV2 construct. The black box represents the coding region, whereas the black lines are the flanking untranslated regions. Arrows show the annealing sites of primers used for qRT-PCR analysis. (Panel B) Ethidium bromide-stained agarose gels showing the detection of the pTRV2 vector by RT-PCR using total RNA extracted from individual plants infiltrated with Agrobacterium tumefaciens harboring the pTRV2-REPI-a, the pTRV2-REPI-5', or the pTRV2-COR1.3 constructs, or the pTRV2 empty vector control. PCR primers (TRV2-MCS) were designed to anneal to regions flanking the multiple cloning site (MCS) of pTRV2. (Panel C) Relative REPI or COR1.3 transcript levels in the stems and roots of REPI-silenced (pTRV2-REPI-a; pRTV2-REPI-5') or COR1.3-silenced (pRTV2-COR1.3) plants compared with controls (pTRV2). (Panel D) Total ion chromatograms showing the major alkaloid profiles of REPI-silenced (pTRV2-REPI-a; pRTV2-REPI-5') or COR1.3 silenced (pRTV2-COR1.3) plants compared with controls (pTRV2). (Panel E) Relative abundance of major latex alkaloids, and other alkaloids showing suppressed levels in REPI-silenced (pTRV2-REPI-a; pRTV2-REPI-5') plants or COR1.3-silenced (pRTV2-COR1.3) plants compared with controls (pTRV2). (Panel F) Ratio of (S)-reticuline to (R)-reticuline in REPI-silenced (pTRV2-REPI-a; pRTV2-REPI-5') plants or COR1.3-silenced (pRTV2-COR1.3) plants compared with controls (pTRV2). Asterisks indicate significant differences determined using an unpaired, two-tailed Student t test (p<0.05). Bars represent the mean ± standard deviation of values obtained from 3 technical replicates for each of 6 individually infiltrated plants.

FIG. 8A shows the activity of the 1,2-Dehydroreticuline reductase (PsDRR) component of *Papaver somniferum* reticuline epimerase (REPI). In the presence of NADH or NADPH, PsDRR converts 1,2-Dehydroreticuline [1] to (R)-reticuline [2] (FIG. 8A, Panel A). In the presence of NAD+ or NADP+, PsDRR converts (R)-reticuline [2] to 1,2-Dehydroreticuline [1] (FIG. 8A, Panel B). FIG. 8B shows the activity of 1,2-Dehydroreticuline reductase (PrDRR) from *Papaver rhoeas*. In the presence of NADH or NADPH, PrDRR converts 1,2-dehydroreticuline [1] to (R)-reticuline [2] (FIG. 8B, Panel A). In the presence of NAD+ or NADP+, PrDRR converts (R)-reticuline [2] to 1,2-Dehydroreticuline [1] (FIG. 8B, Panel B).

DETAILED DESCRIPTION OF THE DISCLOSURE

Figure 1:
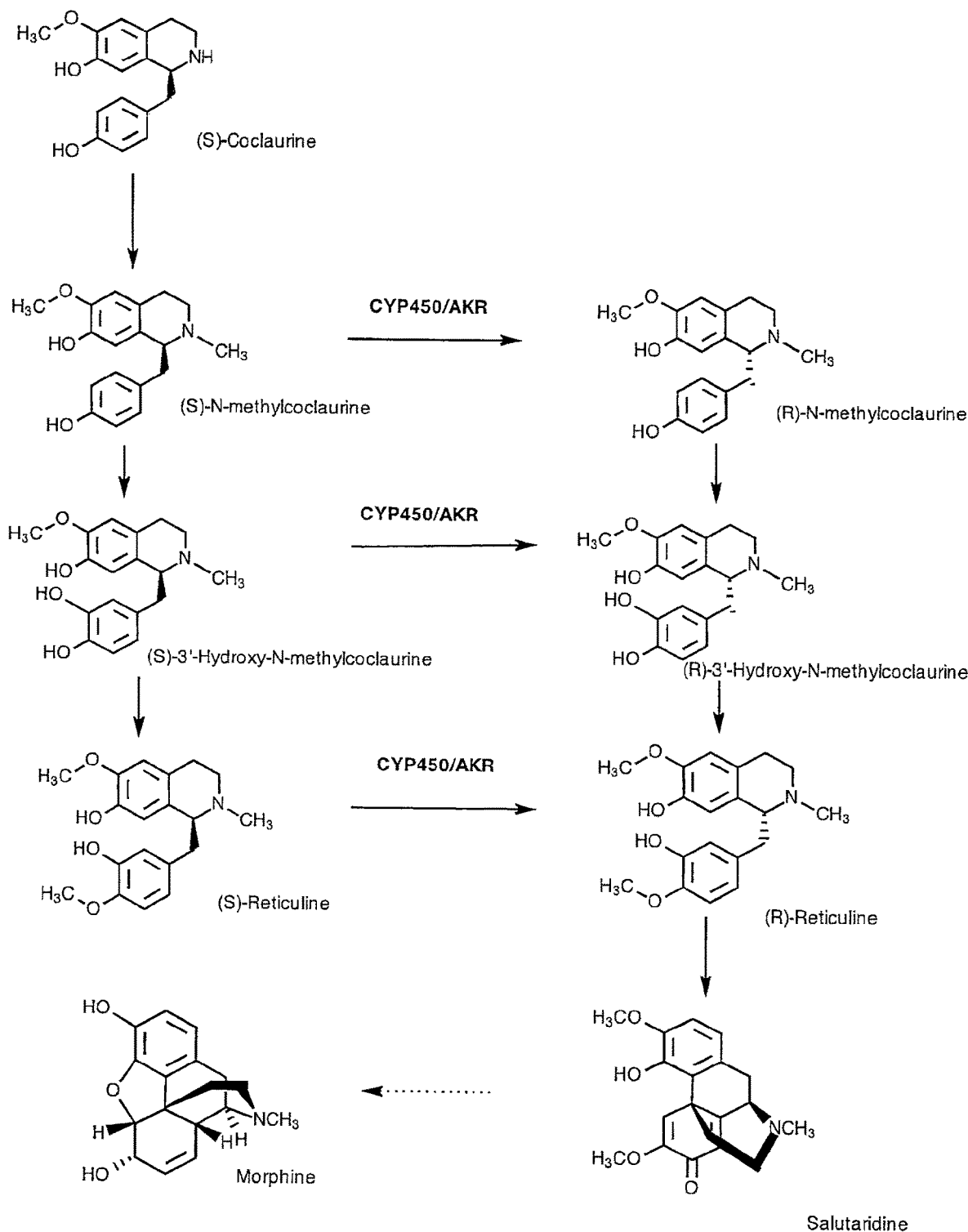
FIG. 1 depicts the synthesis pathway of various benzylisoquinoline precursors to (R)-Reticuline, (R)-Reticuline precursors, morphine and salutaridine. Included are the chemical structures of the shown compounds.

Various compositions and methods will be described below to provide an example of an embodiment of each claimed subject matter. No embodiment described below limits any claimed subject matter and any claimed subject matter may cover methods, processes, compositions or systems that differ from those described below. The claimed subject matter is not limited to compositions or methods having all of the features of any one composition, method, system or process described below or to features common to multiple or all of the compositions, systems or methods described below. It is possible that a composition, system, method or process described below is not an embodiment of any claimed subject matter. Any subject matter disclosed in a composition, system, method or process described below that is not claimed in this document may be the subject matter of another protective instrument, for example, a continuing patent application, and the applicants, inventors or owners do not intend to abandon, disclaim or dedicate to the public any such subject matter by its disclosure in this document.

It should be noted that terms of degree such as "substantially", "essentially" "about" and "approximately" as used herein mean a reasonable amount of deviation of the modified term such that the end result is not significantly changed. These terms of degree should be construed as including a deviation of the modified term if this deviation would not negate the meaning of the term it modifies.

As used herein, the wording "and/or" is intended to represent an inclusive-or. That is, "X and/or Y" is intended to mean X or Y or both, for example. As a further example, "X, Y, and/or Z" is intended to mean X or Y or Z or any combination thereof.

All publications, patents and patent applications are herein incorporated by reference in their entirety to the same extent as if each individual publication.

As hereinbefore mentioned, the present disclosure relates to the secondary metabolite (R)-Reticuline and precursors thereof, as well as to methods of making (R)-Reticuline and precursors thereof. The current disclosure further relates to certain enzymes capable of catalyzing reactions resulting in the conversion of (S)-Reticuline to form (R)-Reticuline. The herein provided methods represent a novel and efficient means of manufacturing (R)-Reticuline and precursors thereof. The methods provided herein do not rely on chemical synthesis and may be conducted at commercial scale. To the best of the inventors' knowledge, the current disclosure provides for the first time a methodology to manufacture (R)-Reticuline and precursors thereof using living cells not normally capable of synthesizing (R)-Reticuline and precursors thereof. Such cells may be used as a source whence (R)-Reticuline and precursors thereof may economically be extracted. (R)-Reticuline and precursors thereof produced in accordance with the present disclosure are useful inter alia in the manufacture of pharmaceutical compositions including morphine and codeine.

Accordingly, the present disclosure provides, in at least one aspect, at least one embodiment of a method of making (R)-Reticuline or a precursor thereof comprising:
(a) providing a benzylisoquinoline derivative;
(b) contacting the benzylisoquinoline derivative with an enzyme mixture capable of converting the benzylisoquinoline derivative to (R)-Reticuline or an (R)-Reticuline precursor under conditions that permit the conversion of the benzylisoquinoline derivative to (R)-Reticuline or an (R)-Reticuline precursor.

The present disclosure further provides in at least one aspect at least one embodiment of a method of making (R)-Reticuline or a precursor of (R)-Reticuline comprising:
(a) providing a benzylisoquinoline derivative;
(b) contacting the benzylisoquinoline derivative with an enzyme mixture capable of converting the benzylisoquinoline derivative to (R)-Reticuline or an (R)-Reticuline precursor under conditions that permit the conversion of the benzylisoquinoline derivative to (R)-Reticuline or an (R)-Reticuline precursor;
wherein the benzylisoquinoline derivative has the chemical formula (I):

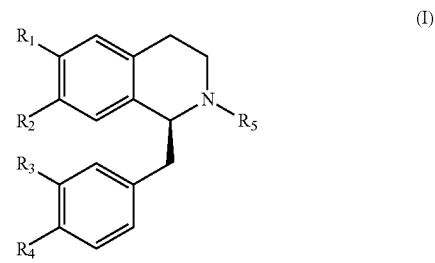

wherein $R_1$, $R_2$, $R_3$ and $R_4$ each represent a hydrogen atom, a hydroxyl group or a methoxy group;
and wherein $R_5$ represents a hydrogen atom or a methyl group; and
wherein the (R)-Reticuline precursor has the chemical formula:

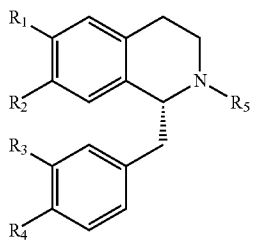

(II)

wherein $R_1$, $R_2$, $R_3$ and $R_4$ each represent a hydrogen atom, a hydroxyl group or a methoxy group;
and wherein $R_5$ represents a hydrogen atom or a methyl group.

Definitions

The term "benzylisoquinoline derivative" as used herein refers to compounds having the chemical formula (VII):

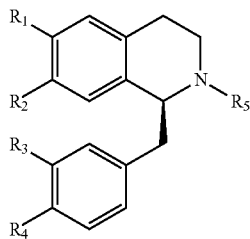

(VII)

wherein $R_1$, $R_2$, $R_3$ and $R_4$ are each independently or simultaneously a hydrogen atom, a hydroxyl group, an alkyl group (for example $C_1$-$C_{10}$-alkyl) or an alkoxy group (for example $C_1$-$C_{10}$-alkoxy), and wherein $R_5$ represents a hydrogen atom or an alkyl group (for example $C_1$-$C_{10}$-alkyl).

The term "(R)-Reticuline precursor", as used herein, refers to a compound having the chemical formula (VIII):

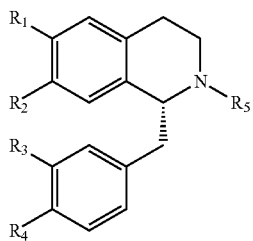

(VIII)

wherein $R_1$, $R_2$, $R_3$ and $R_4$ are each independently or simultaneously a hydrogen atom, a hydroxyl group, an alkyl group (for example $C_1$-$C_{10}$-alkyl) or an alkoxy group (for example $C_1$-$C_{10}$-alkoxy), and wherein $R_5$ represents a hydrogen atom or an alkyl group (for example $C_1$-$C_{10}$-alkyl), with the proviso that chemical formula (VIII) excepts (R)-Reticuline, i.e. specifically excepted from the term (R)-Reticuline precursor as used herein is the chemical compound wherein $R_1$ is a methoxy group; $R_2$ is a hydroxyl group, $R_3$ is a hydroxyl group, $R_4$ is a methoxy group and $R_5$ is a methyl group.

The term "(S)-Reticuline" as used herein refers to the (S)-enantiomer of Reticuline and a chemical compound having the chemical structure (III):

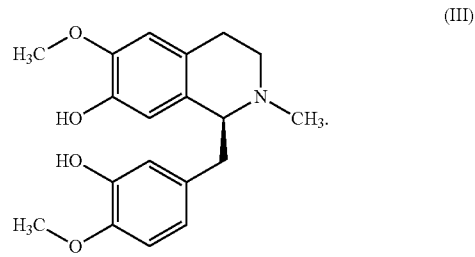 [SMILES: COc1ccc(C[C@H]2c3cc(O)c(OC)cc3CCN2C)cc1O]

(III)

The term "oxidized benzylisoquinoline derivative" refers to a compound having the chemical formula (IX):

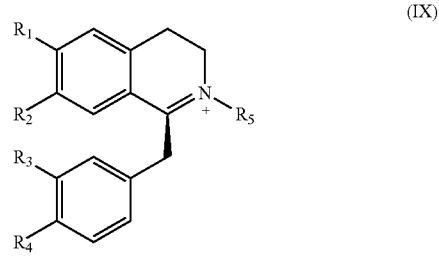

(IX)

wherein $R_1$, $R_2$, $R_3$ and $R_4$ are each independently or simultaneously a hydrogen atom, a hydroxyl group, an alkyl group (for example $C_1$-$C_{10}$-alkyl) or an alkoxy group (for example $C_1$-$C_{10}$-alkoxy), and wherein $R_5$ represents a hydrogen atom or an alkyl group (for example $C_1$-$C_{10}$-alkyl).

The term "(R)-Reticuline" as used herein refers to the (R)-enantiomer of Reticuline and a chemical compound having the chemical structure (V):

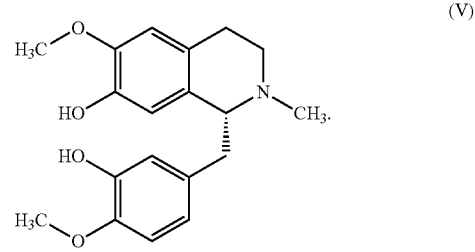 [SMILES: COc1ccc(C[C@@H]2c3cc(O)c(OC)cc3CCN2C)cc1O]

(V)

The term "1,2-Dehydroreticuline" as used herein refers to a chemical compound having the chemical structure (VI):

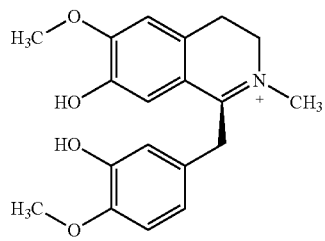

The terms "(R)-Reticuline pathway" or "(R)-Reticuline synthesis pathway", as may be used interchangeably herein, refer to the metabolic pathway for the synthesis of (R)-Reticuline depicted in FIG. 1. When a first chemical compound within the (R)-Reticuline pathway is referenced as " " of a second chemical compound in the pathway, it is meant herein that synthesis of the first chemical compound precedes synthesis of the second chemical compound. Conversely, when a first chemical compound is referenced as "downstream" from a second chemical compound in the (R)-Reticuline pathway, it is meant herein that synthesis of the second chemical compound precedes synthesis of the first chemical compound.

The term "enzyme mixture" as used herein refers to a mixture comprising one or two or more enzymes. It should be noted that in mixtures containing two or more enzymes the enzymes may be independently biologically active without interaction or coordination to form the mixture. In one embodiment, the enzymes contained in the enzyme mixture may associate or interact as independent non-contiguous polypeptide chains. In another embodiment the enzyme mixture may be prepared as a fusion polypeptide between two polypeptides.

The terms "Cytochrome P450", "CYP450" or "P450", which may be used interchangeably herein, refer to any and all enzymes comprising a sequence of amino acid residues which is (i) substantially identical to the amino acid sequences constituting any CYP450 polypeptide set forth herein, including, for example, SEQ. ID NO: 219 to SEQ. ID NO: 321; SEQ. ID NO: 325; and SEQ. ID NO: 338, or (ii) encoded by a nucleic acid sequence capable of hybridizing under at least moderately stringent conditions to any nucleic acid sequence encoding any CYP450 polypeptide set forth herein, but for the use of synonymous codons.

The terms "aldo-keto reductase" or "AKR", which may be used interchangeably herein, in reference to any and all enzymes comprising a sequence of amino acid residues which is (i) substantially identical to the amino acid sequences constituting any AKR polypeptide set forth herein, including, for example, SEQ. ID NO: 59 to SEQ. ID NO: 115; SEQ. ID NO: 327; SEQ. ID NO: 329; SEQ. ID NO: 330; and SEQ. ID NO: 340, or (ii) encoded by a nucleic acid sequence capable of hybridizing under at least moderately stringent conditions to any nucleic acid sequence encoding any AKR polypeptide set forth herein, but for the use of synonymous codons.

The term "nucleic acid sequence" as used herein refers to a sequence of nucleoside or nucleotide monomers consisting of naturally occurring bases, sugars and intersugar (backbone) linkages. The term also includes modified or substituted sequences comprising non-naturally occurring monomers or portions thereof. The nucleic acid sequences of the present disclosure may be deoxyribonucleic acid sequences (DNA) or ribonucleic acid sequences (RNA) and may include naturally occurring bases including adenine, guanine, cytosine, thymidine and uracil. The sequences may also contain modified bases. Examples of such modified bases include aza and deaza adenine, guanine, cytosine, thymidine and uracil, and xanthine and hypoxanthine.

The herein interchangeably used terms "nucleic acid sequence encoding CYP450" and "nucleic acid sequence encoding a CYP450 polypeptide", refer to any and all nucleic acid sequences encoding a CYP450 polypeptide, including, for example, SEQ. ID NO: 116 to SEQ. ID NO: 218; SEQ. ID NO: 324; and SEQ. ID NO: 337. Nucleic acid sequences encoding a CYP450 polypeptide further include any and all nucleic acid sequences which (i) encode polypeptides that are substantially identical to the CYP450 polypeptide sequences set forth herein; or (ii) hybridize to any CYP450 nucleic acid sequences set forth herein under at least moderately stringent hybridization conditions or which would hybridize thereto under at least moderately stringent conditions but for the use of synonymous codons.

The herein interchangeably used terms "nucleic acid sequence encoding AKR" and "nucleic acid sequence encoding an AKR polypeptide", refer to any and all nucleic acid sequences encoding an AKR polypeptide, including, for example, SEQ ID NOs: 1 to 58; SEQ ID NO: 326; SEQ ID NO: 328; SEQ ID NO: 339; and SEQ ID NO: 341. Nucleic acid sequences encoding an AKR polypeptide further include any and all nucleic acid sequences which (i) encode polypeptides that are substantially identical to the AKR polypeptide sequences set forth herein; or (ii) hybridize to any AKR nucleic acid sequences set forth herein under at least moderately stringent hybridization conditions or which would hybridize thereto under at least moderately stringent conditions but for the use of synonymous codons.

By the term "substantially identical" it is meant that two polypeptide sequences preferably are at least 70% identical, and more preferably are at least 85% identical and most preferably at least 95% identical, for example 96%, 97%, 98% or 99% identical. In order to determine the percentage of identity between two polypeptide sequences the amino acid sequences of such two sequences are aligned, using for example the alignment method of Needleman and Wunsch (J. Mol. Biol., 1970, 48: 443), as revised by Smith and Waterman (Adv. Appl. Math., 1981, 2: 482) so that the highest order match is obtained between the two sequences and the number of identical amino acids is determined between the two sequences. Methods to calculate the percentage identity between two amino acid sequences are generally art recognized and include, for example, those described by Carillo and Lipton (SIAM J. Applied Math., 1988, 48:1073) and those described in Computational Molecular Biology, Lesk, e.d. Oxford University Press, New York, 1988, Biocomputing: Informatics and Genomics Projects. Generally, computer programs will be employed for such calculations. Computer programs that may be used in this regard include, but are not limited to, GCG (Devereux et al., Nucleic Acids Res., 1984, 12: 387) BLASTP, BLASTN and FASTA (Altschul et al., J. Molec. Biol., 1990:215:403). A particularly preferred method for determining the percentage identity between two polypeptides involves the Clustal W algorithm (Thompson, J D, Higgines, D G and Gibson T J, 1994, Nucleic Acid Res 22(22): 4673-4680 together with the BLOSUM 62 scoring matrix (Henikoff S & Henikoff, J G, 1992, Proc. Natl. Acad. Sci. USA 89: 10915-10919 using a gap opening penalty of 10 and a gap extension penalty of 0.1, so that the highest order match obtained between two sequences wherein at least 50% of the total length of one of the two sequences is involved in the alignment.

By "at least moderately stringent hybridization conditions" it is meant that conditions are selected which promote selective hybridization between two complementary nucleic acid molecules in solution. Hybridization may occur to all or a portion of a nucleic acid sequence molecule. The hybridizing portion is typically at least 15 (e.g. 20, 25, 30, 40 or 50) nucleotides in length. Those skilled in the art will recognize that the stability of a nucleic acid duplex, or hybrids, is determined by the Tm, which in sodium containing buffers is a function of the sodium ion concentration and temperature (Tm=81.5° C.-16.6 (Log 10 [Na+])+0.41 (% (G+C)−600/l), or similar equation). Accordingly, the parameters in the wash conditions that determine hybrid stability are sodium ion concentration and temperature. In order to identify molecules that are similar, but not identical, to a known nucleic acid molecule a 1% mismatch may be assumed to result in about a 1° C. decrease in Tm, for example if nucleic acid molecules are sought that have a >95% identity, the final wash temperature will be reduced by about 5° C. Based on these considerations those skilled in the art will be able to readily select appropriate hybridization conditions. In preferred embodiments, stringent hybridization conditions are selected. By way of example the following conditions may be employed to achieve stringent hybridization: hybridization at 5× sodium chloride/sodium citrate (SSC)/5×Denhardt's solution/1.0% SDS at Tm (based on the above equation)−5° C., followed by a wash of 0.2×SSC/0.1% SDS at 60° C. Moderately stringent hybridization conditions include a washing step in 3×SSC at 42° C. It is understood however that equivalent stringencies may be achieved using alternative buffers, salts and temperatures. Additional guidance regarding hybridization conditions may be found in: Current Protocols in Molecular Biology, John Wiley & Sons, N.Y., 1989, 6.3.1.-6.3.6 and in: Sambrook et al., Molecular Cloning, a Laboratory Manual, Cold Spring Harbor Laboratory Press, 1989, Vol. 3.

The term "chimeric" as used herein in the context of nucleic acid sequences refers to at least two linked nucleic acid sequences which are not naturally linked. Chimeric nucleic acid sequences include linked nucleic acid sequences of different natural origins. For example a nucleic acid sequence constituting a yeast promoter linked to a nucleic acid sequence encoding a COR protein is considered chimeric. Chimeric nucleic acid sequences also may comprise nucleic acid sequences of the same natural origin, provided they are not naturally linked. For example a nucleic acid sequence constituting a promoter obtained from a particular cell-type may be linked to a nucleic acid sequence encoding a polypeptide obtained from that same cell-type, but not normally linked to the nucleic acid sequence constituting the promoter. Chimeric nucleic acid sequences also include nucleic acid sequences comprising any naturally occurring nucleic acid sequence linked to any non-naturally occurring nucleic acid sequence.

The terms "substantially pure" and "isolated", as may be used interchangeably herein describe a compound, e.g., a pathway synthesis intermediate or a polypeptide, which has been separated from components that naturally accompany it. Typically, a compound is substantially pure when at least 60%, more preferably at least 75%, more preferably at least 90%, 95%, 96%, 97%, or 98%, and most preferably at least 99% of the total material (by volume, by wet or dry weight, or by mole percent or mole fraction) in a sample is the compound of interest. Purity can be measured by any appropriate method, e.g., in the case of polypeptides, by chromatography, gel electrophoresis or HPLC analysis.

The term "recovered" as used herein in association with an enzyme or protein refers to a more or less pure form of the enzyme or protein.

The term "in vivo" as used herein to describe methods of making (R)-Reticuline or an (R)-Reticuline precursor refers to contacting a benzylisoquinoline derivative with an enzyme capable of catalyzing conversion of the benzylisoquinoline derivative within a living cell, including, for example, a microbial cell or a plant cell, to form (R)-Reticuline or an (R)-Reticuline precursor.

The term "in vitro" as used herein to describe methods of making (R)-Reticuline or an (R)-Reticuline precursor refers to contacting a benzylisoquinoline derivative with an enzyme capable of catalyzing conversion of the benzylisoquinoline derivative in an environment outside a living cell, including, without limitation, for example, in a microwell plate, a tube, a flask, a beaker, a tank, a reactor and the like, to form (R)-Reticuline or an (R)-Reticuline precursor.

General Implementation

Synthesis of (R)-Reticuline and (R)-Reticuline Precursors

The present disclosure provides in at least one aspect at least one embodiment of making (R)-Reticuline or an (R)-Reticuline precursor comprising:

(a) providing a benzylisoquinoline derivative;

(b) contacting the benzylisoquinoline derivative with an enzyme mixture capable of converting the benzylisoquinoline derivative to (R)-Reticuline or an (R)-Reticuline precursor under conditions that permit the conversion of the benzylisoquinoline derivative to (R)-Reticuline or an (R)-Reticuline precursor;

wherein the benzylisoquinoline derivative has the chemical formula (I):

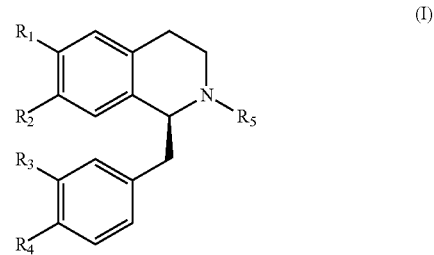

(I)

wherein $R_1$, $R_2$, $R_3$ and $R_4$ each represent a hydrogen atom, a hydroxyl group or a methoxy group;

and wherein $R_5$ represents a hydrogen atom or a methyl group; and wherein the (R)-Reticuline precursor has the chemical formula (II):

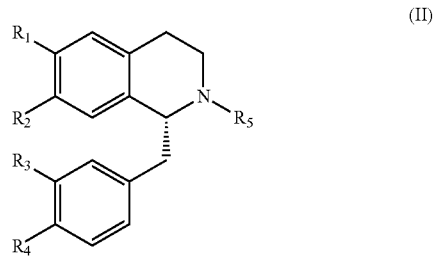

(II)

wherein $R_1$, $R_2$, $R_3$ and $R_4$ each represent a hydrogen atom, a hydroxyl group or a methoxy group;

and wherein $R_5$ represents a hydrogen atom or a methyl group, with the proviso that chemical formula (II) excepts (R)-Reticuline.

In a preferred embodiment, the benzylisoquinoline derivative (I) is a derivative wherein $R_1$ is methoxy group, $R_2$ is a hydroxyl group, $R_3$ is a hydrogen atom or a hydroxyl group, $R_4$ is a hydroxyl group or a methoxy group, and $R_5$ is a hydrogen atom or methyl group.

In a further preferred embodiment, the benzylisoquinoline derivative (I) is a derivative wherein $R_1$ is a methoxy group, $R_2$ is a hydroxyl group, $R_3$ is a hydrogen atom, $R_4$ is a hydroxyl group and $R_5$ is a hydrogen atom. This compound is also known as (S)-Coclaurine (see: FIG. 1).

In a further preferred embodiment, the benzylisoquinoline derivative (I) is a derivative wherein $R_1$ is a methoxy group, $R_2$ is a hydroxyl group, $R_3$ is a hydrogen atom, $R_4$ is a hydroxyl group and $R_5$ is a methyl group. This compound is also known as (S)—N-methyl-coclaurine (see: FIG. 1).

In a further preferred embodiment, the benzylisoquinoline derivative (I) is a derivative wherein $R_1$ is a methoxy group, $R_2$ is a hydroxyl group, $R_3$ is a hydroxyl group, $R_4$ is a hydroxyl group and $R_5$ is a methyl group. This compound is also known as (S)-3'-hydroxy-N-methylcoclaurine (see: FIG. 1).

In a further preferred embodiment, the benzylisoquinoline derivative (I) is a derivative wherein $R_1$ is a methoxy group, $R_2$ is a hydroxyl group, $R_3$ is a hydroxyl group, $R_4$ is a methoxy group and $R_5$ is a methyl group. This compound is also known as (S)-Reticuline (see: FIG. 1; compound (III)).

In a further preferred embodiment, the (R)-Reticuline derivative (II) is a derivative wherein $R_1$ is a methoxy group, $R_2$ is a hydroxyl group, $R_3$ is a hydrogen atom or a hydroxyl group, $R_4$ is a hydroxyl group and $R_5$ is a methyl group.

In a further preferred embodiment, the (R)-Reticuline derivative (II) is a derivative wherein $R_1$ is a methoxy group, $R_2$ is a hydroxyl group, $R_3$ is a hydrogen atom, $R_4$ is a hydroxyl group and $R_5$ is a methyl group. This compound is also known as (R)—N-Methylcoclaurine (see: FIG. 1).

In a further preferred embodiment the (R)-Reticuline derivative (II) is a derivative wherein $R_1$ is a methoxy group, $R_2$ is a hydroxyl group, $R_3$ is a hydroxyl group, $R_4$ is a hydroxyl group and $R_5$ is a methyl group. This compound is also known as (R)-3'-Hydroxy-N-methylcoclaurine (see: FIG. 1).

In a further preferred embodiment, the benzylisoquinoline derivative (I) is a derivative wherein $R_1$ is a methoxy group, $R_2$ is a hydroxyl group, $R_3$ is a hydrogen atom, $R_4$ is a hydroxyl group and $R_5$ is a methyl group; and the (R)-Reticuline derivative (II) is a derivative wherein $R_1$ is a methoxy group, $R_2$ is a hydroxyl group, $R_3$ is a hydrogen atom, $R_4$ is a hydroxyl group and $R_5$ is a methyl group.

In a further preferred embodiment, the benzylisoquinoline derivative (I) is a derivative wherein $R_1$ is a methoxy group, $R_2$ is a hydroxyl group, $R_3$ is a hydroxyl group, $R_4$ is a hydroxyl group and $R_5$ is a methyl group; and (R)-Reticuline derivative (II) is a derivative wherein $R_1$ is methoxy group, $R_2$ is a hydroxyl group, $R_3$ is a hydroxyl group, $R_4$ is a hydroxyl group and $R_5$ is a methyl group.

In a preferred embodiment of the disclosure, there is provided a method of making (R)-Reticuline comprising:
(a) providing (S)-Reticuline; and
(b) contacting (S)-Reticuline with an enzyme mixture capable of converting (S)-Reticuline to (R)-Reticuline under conditions that permit the conversion of (S)-Reticuline to (R)-Reticuline.

Figure 2:
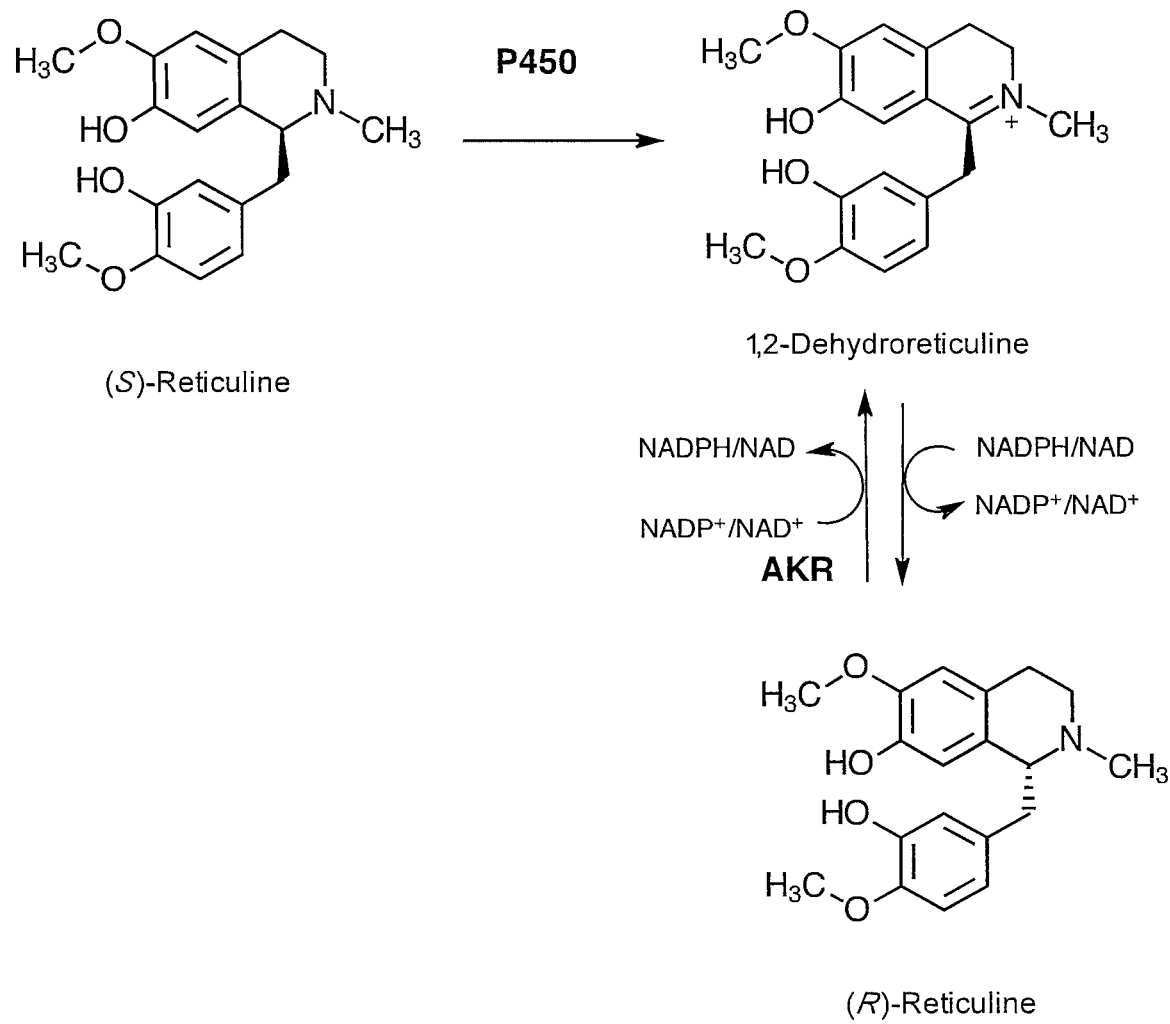
FIG. 2 depicts a synthesis pathway for the manufacture of (R)-Reticuline from (S)-Reticuline and synthesis intermediates thereof. Included are the chemical structures of the synthesis intermediates and enzymes capable of catalyzing chemical conversion of the synthesis intermediates.

In preferred embodiments, the enzyme mixture comprises a first polypeptide capable of oxidizing (S)-Reticuline to form 1,2-Dehydroreticuline and a second polypeptide capable of reducing 1,2-Dehydroreticuline to form (R)-Reticuline (see: FIG. 2).

In preferred embodiments, the enzyme mixture comprises a first polypeptide capable of oxidizing the benzylisoquinoline derivative (I) to form an oxidized benzylisoquinoline derivative having the chemical formula (IV):

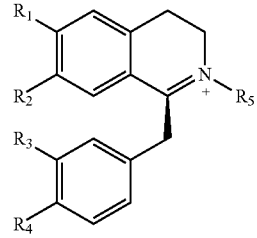

(IV)

wherein, in preferred embodiments, $R_1$, $R_2$, $R_3$ and $R_4$ each represent a hydrogen atom, a hydroxyl group or a methoxy group; and wherein, in preferred embodiments, $R_5$ represents a hydrogen atom or a methyl group; and a second polypeptide capable of reducing the oxidized benzylisoquinoline derivative having the chemical formula (IV) to form (R)-Reticuline or an (R)-Reticuline derivative having chemical formula (II) wherein $R_1$, $R_2$, $R_3$ and $R_4$ each represents a hydrogen atom, a hydroxyl group or a methoxy group; and wherein $R_5$ represents a hydrogen atom or a methyl group, with the proviso that chemical formula (II) excepts (R)-Reticuline.

In preferred embodiments, the first polypeptide capable of oxidizing the benzylisoquinoline derivative (I) to form the oxidized benzylisoquinoline derivative (IV) is a cytochrome P450 and the second polypeptide capable of reducing oxidized benzylisoquinoline derivative to form (R)-Reticuline or a (R)-Reticuline derivative is an aldo-keto reductase (AKR). In particularly preferred embodiments, the AKR polypeptides are obtained from or obtainable from *P. somniferum, P. bracteatum* and *P. rhoeas*.

In certain embodiments, the first and second polypeptide are provided in the form of two separate polypeptides, i.e. polypeptides that are not connected by covalent chemical bonds. In certain preferred embodiments, the first and second polypeptide are prepared as a fusion polypeptide comprising a first portion encoding a CYP450 polypeptide and a second portion encoding an AKR polypeptide. Such fusion polypeptide may be prepared recombinantly or it may be a naturally occurring fusion polypeptide may be used, such as the *Papaver somniferum* polypeptide set forth in SEQ. ID NO: 323.

Examples of a CYP450 polypeptide that may be used in accordance with the present disclosure include the polypeptides set forth in. SEQ. ID NO: 219 to SEQ. ID NO: 321; SEQ. ID NO: 325; and SEQ. ID NO: 338. Examples of AKR polypeptides that may be used in accordance with the present disclosure include the polypeptides set forth in SEQ. ID NO: 59 to SEQ. ID NO: 115; SEQ. ID NO: 327; SEQ. ID NO: 329; SEQ. ID NO: 330: and SEQ. ID NO: 340.

The foregoing reactions are performed under conditions permitting the conversion of the benzylisoquinoline precursor to (R)-Reticuline or a (R)-Reticuline precursor. The conditions include in vivo or in vitro conditions, as hereinafter further detailed. The conditions further typically include the presence of water and buffering agents. Further typically included are a reducing agent in order to permit a reduction reaction resulting in the conversion of the oxidized benzylisoquinoline precursor to (R)-Reticuline or to a (R)-Reticuline precursor. The reducing agent may be nicotinamide adenine dinucleotide (NADH), and in other embodiments, the reducing agent is nicotinamide adenine dinucleotide phosphate (NADPH). Further typically included in the reaction is a reductase capable of reducing the enzyme converting the benzylisoquinoline derivative to the oxidized benzylisoquinoline and a reducing agent. In preferred embodiments, the reductase is a cytochrome P450 reductase, such as for example the opium poppy cytochrome P450 reductase, capable of reducing CYP450, and the reducing agent is NADH, or more preferably, NADPH. It is further noted that the reactions may be conducted at various pH's, e.g. at approximately pH 3, pH 4, pH 5, pH 6, pH 7, pH 8, pH, 9 or pH 10. It will be clear to those of skill in the art that an optimal pH may be identified for a reaction by conducting the reaction at a range of different pH's, and evaluating the reaction rate, as illustrated in Example 7 hereof. The optimal pH may vary depending on, for example, the substrate and enzyme selected in accordance herewith. Thus, by way of example only, Example 7 documents an optimal pH of approximately pH 8 for the conversion of (S)-Reticuline to 1,2-Dehydroreticuline, an optimal pH of approximately pH 7 for the conversion of 1,2-Dehydroreticuline to (R)-Reticuline, and an optimal pH of approximately pH 9 for the conversion of (R)-Reticuline to 1,2-Dehydroreticuline.

It is noted that in accordance herewith, depending on the reaction conditions selected, the reaction involving the conversion of 1,2-Dehydroreticuline to (R)-Reticuline may be reversed, or partially reversed. Thus, as documented in Example 6, (R)-Reticuline may be converted to 1,2-Dehydroreticuline. Accordingly, the present disclosure further provides a method of making 1,2-Dehydroreticuline comprising:

(a) providing (R)-Reticuline; and
(b) contacting (R)-Reticuline with an AKR polypeptide capable of converting (R)-Reticuline to 1,2-Dehydroreticuline under conditions that permit the conversion of (R)-Reticuline to 1,2-Dehydroreticuline. The AKR polypeptides that may be used to conduct the foregoing reaction include any polypeptide set forth in SEQ. ID NO: 59 to SEQ. ID NO: 115; SEQ. ID NO: 327; SEQ. ID NO: 329; SEQ. ID NO: 330; and SEQ. ID NO: 340. Reaction conditions permitting the conversion include the presence in the reaction mixture of an oxidizing agent, preferably $NAD^+$ or $NADP^+$. As noted above the pH for the reaction may be optimized. The reversibility of the foregoing reaction is further illustrated in FIG. 2

In preferred embodiments, the first polypeptide capable of oxidizing the benzylisoquinoline derivative to form the oxidized benzylisoquinoline derivative is a cytochrome P450 and the second polypeptide capable of reducing the oxidized benzylisoquinoline derivative to form (R)-Reticuline or a (R)-Reticuline derivative is an aldo-keto reductase (AKR). In particularly preferred embodiments, the AKR is obtained from or obtainable from *P. somniferum, P. bracteatum* and *P. rhoeas*.

In certain embodiments, the first and second polypeptide are provided in the form of two separate polypeptides, i.e. polypeptides that are not connected by covalent chemical bonds. In certain preferred embodiments, the first and second polypeptide are prepared as a fusion polypeptide comprising a first portion encoding a CYP450 polypeptide and a second portion encoding an AKR polypeptide. Such fusion polypeptide may be prepared recombinantly, or it may be a naturally occurring fusion polypeptide may be used, such as the *Papaver somniferum* polypeptide set forth in SEQ. ID NO: 323.

Examples of a CYP450 polypeptide that may be used in accordance with the present disclosure include CYP450 polypeptides obtainable from various *Papaver* species, including, *Papaver somniferum, Papaver rhoeas* and *Papaver bracteatum; Argemone* species, including *Argemone mexicana; Berberis* species, including *Berberis thunbergii; Corydalis* species, including *Corydalis chelantifolia; Chelidonium* species, including, *Chelidonium majus; Cissampelos* species, including *Cissampelos mucronata; Cocculus* species, including *Cocculus trilobus; Corydalis* species, including *Corydalis chelantifolia; Glaucium* species, including *Glaucium flavum; Hydrastis* species, including *Hydrastis canadensis; Jeffersonia* species, including *Jeffersonia diphylla; Mahonia* species, including *Mahonia aquifolium; Menispermum* species, including *Menispermum canadense; Nandina* species, including *Nandina domestica; Nigella* species, including *Nigella sativa; Sanguinaria* species, including *Sanguinaria canadensis; Styplophorum* species, *Stylophorum diphyllum, Thalictrum* species, including *Thalictrum flavum; Tinospora* species, including *Tinospora cordifolia;* and *Xanthoriza* species, including *Xanthoriza simplicissima*. The foregoing specifically include the polypeptides from the aforementioned species set forth herein in SEQ. ID NO: 219 to SEQ. ID NO: 321; SEQ. ID NO: 325; and SEQ. ID NO: 338. Examples of a AKR polypeptide that may be used in accordance with the present disclosure include AKR polypeptides obtainable from various *Papaver* species, including, *Papaver somniferum, Papaver rhoeas* and *Papaver bracteatum; Argemone* species, including *Argemone mexicana; Berberis* species, including *Berberis thunbergii; Corydalis* species, including *Corydalis chelantifolia; Chelidonium* species, including, *Chelidonium majus; Cissampelos* species, including *Cissampelos mucronata; Cocculus* species, including *Cocculus trilobus; Corydalis* species, including *Corydalis chelantifolia; Glaucium* species, including *Glaucium flavum; Hydrastis* species, including *Hydrastis canadensis; Jeffersonia* species, including *Jeffersonia diphylla; Mahonia* species, including *Mahonia aquifolium; Menispermum* species, including *Menispermum canadense; Nandina* species, including *Nandina domestica; Nigella* species, including *Nigella sativa; Sanguinaria* species, including *Sanguinaria canadensis; Styplophorum* species, *Stylophorum diphyllum, Thalictrum* species, including *Thalictrum flavum; Tinospora* species, including *Tinospora cordifolia;* and *Xanthoriza* species, including *Xanthoriza simplicissima*. The foregoing specifically include the polypeptides from the aforementioned species set forth herein in SEQ. ID NO: 59 to SEQ. ID NO: 115; SEQ. ID NO: 327; SEQ. ID NO: 329; SEQ. ID NO: 330; and SEQ. ID NO: 340.

The foregoing reactions are performed under conditions permitting the conversion of the benzylisoquinoline precursor to (R)-Reticuline or a (R)-Reticuline precursor. The conditions include in vivo or in vitro conditions, as hereinafter further detailed. The conditions further typically include the presence of water and buffering agents. Further typically included are a reducing agent in order to permit a reduction reaction resulting in the conversion of the oxidized benzylisoquinoline precursor to (R)-Reticuline or to a (R)-Reticuline precursor. The reducing agent may be nicotinamide adenine dinucleotide (NADH), and in other embodiments, the reducing agent is nicotinamide adenine dinucleotide phosphate (NADPH). Further typically included in the reaction is a reductase capable of reducing the enzyme converting the benzylisoquinoline derivative to the oxidized benzylisoquinoline and a reducing agent. In preferred embodiments, the reductase is a cytochrome P450 reductase capable of reducing CYP450, and the reducing agent is NADH, or more preferably, NADPH.

In Vitro Synthesis of (R)-Reticuline or (R)-Reticuline Derivatives

In accordance with certain aspects of the present disclosure, a benzylisoquinoline derivative is brought in contact with catalytic quantities of the enzymes CYP450 and AKR under reaction conditions permitting an enzyme catalyzed chemical conversion of the benzylisoquinoline derivative under in vitro reaction conditions. Under such in vitro reaction conditions the initial reaction constituents are provided in more or less pure form and are mixed under conditions that permit the requisite chemical reactions to substantially proceed. Substantially pure forms of the initial benzylisoquinoline derivative may be purchased. (S)-Reticuline, for example, may be purchased (e.g. from Santa Cruz Biotechnology Inc.) as a substantially pure chemical compound, chemically synthesized from precursor compounds, or isolated from natural sources including *Papaver somniferum* and other members of the Papaveraceae, Lauraceae, Annonaceae, Euphorbiaceae or Moraceae families of plants comprising such compounds as desired. Suitable Papaveraceae members include, but are not limited to, species belonging to the genus *Papaver, Corydalis; Chelidonium*; and *Romeria*. Such species may be able to make (S)-Reticuline, including, but not limited to, plant species selected from the species *Chelidonium majus; Corydalis bulbosa; Corydalis cava; Corydalis ochotenis; Corydalis ophiocarpa; Corydalis platycarpa; Corydalis tuberosa; Papaver armeniacum; Papaver Bracteatum; Papaver cylindricum; Papaver decaisnei; Papaver fugax; Papaver oreophyllum; Papaver orientale; Papaver paeonifolium; Papaver persicum; Papaver pseudo-orientale; Papaver rhoeas; Papaver rhopalothece; Papaver setigerum; Papaver somniferum; Papaver tauricolum; Papaver triniaefolium*; and *Romeria carica*. Chemical synthesis of (S)-Reticuline may be performed using standard methods as described, for example, in S. Teitel and A. Bross, Journal of Heterocyclic Chemistry 5, 825-829, 1968.

In accordance herewith, more or less pure forms of the enzymes may be isolated from natural sources, including, but not limited to, *Papaver somniferum, Papaver bracteatum* and *Papaver rhoeas*, or they may be prepared recombinantly, or synthetically. Thus, provided herein is further a method for preparing an enzyme selected from the group consisting of CYP450 and AKR, or a mixture thereof comprising:

(a) providing a chimeric nucleic acid sequence comprising as operably linked components:
  (i) one or both nucleic acid sequences encoding one or more of the polypeptides selected from the group consisting of CYP450 and AKR; and
  (ii) one or more nucleic acid sequences capable of controlling expression in a host cell;
(b) introducing the chimeric nucleic acid sequence into a host cell and growing the host cell to produce the polypeptide selected from the group consisting of CYP450 and AKR; and
(c) recovering a polypeptide selected from the group consisting of CYP450 and AKR or from the host cell.

The nucleic acid sequence may be obtained from any natural source, e.g. a plant source, containing such sequences. Preferred plant sources include *Papaver* species, including, *Papaver somniferum, Papaver rhoeas* and *Papaver bracteatum; Argemone* species, including *Argemone mexicana; Berberis* species, including *Berberis thunbergii; Corydalis* species, including *Corydalis chelantifoli; Chelidonium* species, including, *Chelidonium majus; Cissampelos* species, including *Cissampelos mucronata; Cocculus* species, including *Cocculus trilobus; Corydalis* species, including *Corydalis chelantifolia; Glaucium* species, including *Glaucium flavum; Hydrastis* species, including *Hydrastis canadensis; Jeffersonia* species, including *Jeffersonia diphylla; Mahonia* species, including *Mahonia aquifolium; Menispermum* species, including *Menispermum canadense; Nandina* species, including *Nandina domestica; Nigella* species, including *Nigella sativa; Sanguinaria* species, including *Sanguinaria canadensis; Styplophorum* species, *Stylophorum diphyllum, Thalictrum* species, including *Thalictrum flavum; Tinospora* species, including *Tinospora cordifolia*; and *Xantboriza* species, including *Xanthoriza simplicissima*. With respect to CYP450 the nucleic acid sequences obtainable or obtained from the aforementioned plant species include the nucleic acid sequence set forth in SEQ ID NOs: 116 to 218; SEQ ID NO: 324; and SEQ ID NO: 337. With respect to AKR the nucleic acid sequences obtainable or obtained from the aforementioned plant species include the nucleic acid sequence set forth herein as SEQ ID NO: 1 to SEQ ID NO: 58; SEQ ID NO: 326; SEQ ID NO: 328; SEQ ID NO: 339; and SEQ ID NO: 341. In further preferred embodiments, a nucleic acid sequence encoding a natural fusion polypeptide between CYP450 and AKR forth may be used, including the nucleic acid sequence set forth herein in SEQ ID NO: 322.

Growth of the host cells leads to production of the CYP450 and/or AKR polypeptides. The polypeptides subsequently may be recovered, isolated and separated from other host cell components by a variety of different protein purification techniques including, e.g. ion-exchange chromatography, size exclusion chromatography, affinity chromatography, hydrophobic interaction chromatography, reverse phase chromatography, gel filtration, etc. Further general guidance with respect to protein purification may for example be found in: Cutler, P. Protein Purification Protocols, Humana Press, 2004, Second Ed. Thus substantially pure preparations of the CYP450 and/or AKR polypeptides may be obtained.

In accordance herewith a benzylisoquinoline derivative is brought in contact with catalytic quantities of one or more of the enzymes CYP450 and AKR under reaction conditions permitting an enzyme catalyzed chemical conversion of the benzylisoquinoline derivative. In preferred embodiments, the agents are brought in contact with each other and mixed to form a mixture. In preferred embodiments, the mixture is an aqueous mixture comprising water and further optionally additional agents to facilitate enzyme catalysis, including buffering agents, salts, pH modifying agents. As hereinbefore mentioned, it is particularly preferred that the reaction mixture comprises NADPH and a reductase. The reaction may be performed at a range of different temperatures. In preferred embodiments, the reaction is performed at a temperature between about 18° C. and about 37° C. Upon completion of the in vitro reaction (R)-Reticuline or a (R)-Reticuline precursor may be obtained in more or less pure form.

In Vivo Synthesis of (R)-Reticuline or a (R)-Reticuline Precursor

In accordance with certain aspects of the present disclosure, a benzylisoquinoline derivative is brought in contact with catalytic quantities of one or more of the enzymes CYP450 and AKR under reaction conditions permitting an enzyme catalyzed chemical conversion of the benzylisoquinoline derivative under in vivo reaction conditions. Under such in vivo reaction conditions living cells are modified in such a manner that they produce (R)-Reticuline or an (R)-Reticuline precursor. In certain embodiments, the living cells are microorganisms, including bacterial cells and fungal cells. In other embodiments, the living cells are multicellular organisms, including plants and plant cell cultures.

In one embodiment, the living cells are selected to be host cells not naturally capable of capable of producing a benzylisoquinoline derivative, (S)-Reticuline, a (R)-Reticuline precursor or (R)-Reticuline. In another embodiment, the host cells are naturally capable of producing (S)-Reticuline or a benzylisoquinoline derivative but not (R)-Reticuline or an (R)-Reticuline precursor, i.e. the cells are not naturally capable of performing the epimerization reaction from the (S)-enantiomer to the (R)-enantiomer. In another embodiment, the cells are able to produce a benzylisoquinoline derivative or (S)-Reticuline and (R)-Reticuline or a (R)-Reticuline precursor but the levels of (R)-Reticuline or (R)-Reticuline precursor are lower than desirable and the levels of (R)-Reticuline or (R)-Reticuline precursor are modulated relative to the levels in the unmodified cells. Such cells include, without limitation, bacteria, yeast, other fungal cells, plant cells, or animal cells.

In order to produce (R)-Reticuline or (R)-Reticuline precursor, provided herein is further a method for preparing (R)-Reticuline or (R)-Reticuline precursor comprising:
  (a) providing a chimeric nucleic acid sequence comprising as operably linked components:
    (i) a first nucleic acid sequence encoding a CYP450 polypeptide;
    (ii) a second nucleic acid sequence encoding an AKR polypeptide; and
    (iii) one or more nucleic acid sequences capable of controlling expression in a host cell;
  (b) introducing the chimeric nucleic acid sequence into a host cell and growing the host cell to produce CYP450 and AKR and to produce (R)-Reticuline or (R)-Reticuline precursor; and
  (c) recovering (R)-Reticuline or (R)-Reticuline precursor.

In preferred embodiments, the first and second nucleic acid sequences are operably linked in order to produce a fusion polypeptide comprising CYP450 and AKR.

There is further provided a method for preparing (R)-Reticuline or (R)-Reticuline precursor comprising:
  (b) providing a first chimeric nucleic acid sequence comprising as operably linked components a first nucleic acid sequence encoding a CYP450 polypeptide and a first nucleic acid sequence controlling expression of the first nucleic acid sequence in the cell;
  (c) providing a second chimeric nucleic acid sequence comprising as operably linked components a second nucleic acid sequence encoding an AKR polypeptide and a second nucleic acid sequence controlling expression of the second nucleic acid sequence in the cell;
  (c) introducing the first and second chimeric nucleic acid sequences into a host cell and growing the host cell to produce CYP450 and AKR and to produce (R)-Reticuline or (R)-Reticuline precursor; and
  (d) recovering (R)-Reticuline or (R)-Reticuline precursor.

In preferred embodiments, the nucleic acid sequences encoding CYP450 and AKR are selected from the nucleic acid sequences encoding CYP450 and AKR obtainable or obtained from *Papaver somniferum* and other members of the *Papaveraceae, Lauraceae, Annonaceae, Euphorbiaceae* or *Moraceae* family of plants comprising such compounds as desired. Suitable Papaveraceae members include, but are not limited to, species belonging to the genus Papaver; Corydalis; Chelidonium; and Romeria. Such species may be able to make (R)-Reticuline, including, but not limited to, plant species selected from the species *Chelidonium majus; Corydalis bulbosa; Corydalis cava; Corydalis ochotenis; Corydalis ophiocarpa; Corydalis platycarpa; Corydalis tuberosa; Papaver armeniacum; Papaver Bracteatum; Papaver cylindricum; Papaver decaisnei; Papaver fugax; Papaver oreophyllum; Papaver orientale; Papaver paconifolium; Papaver persicum; Papaver psuedo-orientale; Papaver rhoeas; Papaver rhopalothece; Papaver setigerum; Papaver somniferum; Papaver tauricolum; Papaver triniaefolium*; and *Romeria carica*. In particularly preferred embodiments, the nucleic acid sequences encoding CYP450 and AKR are nucleic acid sequences selected from the nucleic acid sequences encoding CYP450 and AKR obtainable or obtained from *Papaver somniferum, Papaver bracteatum* and *Papaver rhoeas*. In further preferred embodiments, one of the nucleic acid sequences encoding CYP450 set forth herein as SEQ ID NOs: 116 to 218; SEQ ID NO: 324 ; and SEQ ID NO: 337. In preferred embodiments, the nucleic acid sequence encoding the AKR is one of the nucleic acid sequences encoding AKR set forth herein as SEQ ID NOs: 1 to 58; SEQ ID NO: 326; SEQ ID NO: 328; SEQ ID NO: 339; and SEQ ID NO: 341. In further particularly preferred embodiments, the nucleic acid sequences encoding CYP450 and AKR are nucleic acid sequences capable of producing a CYP450-AKR fusion polypeptide, including without limitation the sequence set forth in SEQ ID NO: 322.

In accordance herewith, the nucleic acid sequence encoding CYP450 and AKR are linked to a nucleic acid sequence capable of controlling expression CYP450 and AKR in a host cell. Accordingly, the present disclosure also provides a nucleic acid sequence encoding CYP450 and AKR linked to a promoter capable of controlling expression in a host cell. Nucleic acid sequences capable of controlling expression in host cells that may be used herein include any transcriptional promoter capable of controlling expression of polypeptides in host cells. Generally, promoters obtained from bacterial cells are used when a bacterial host is selected in accordance herewith, while a fungal promoter will be used when a fungal host is selected, a plant promoter will be used when a plant cell is selected, and so on. Further nucleic acid elements capable elements of controlling expression in a host cell include transcriptional terminators, enhancers and the like, all of which may be included in the chimeric nucleic acid sequences of the present disclosure. It will be understood by those ordinary skill in the art that operable linkage of nucleic acid sequences includes linkage of promoters and sequences capable of controlling expression to coding sequences in the 5' to 3' direction of transcription.

In accordance with the present disclosure, the chimeric nucleic acid sequences comprising a promoter capable of controlling expression in host cell linked to a nucleic acid sequence encoding CYP450 and AKR, can be integrated into a recombinant expression vector which ensures good expression in the host cell. Accordingly, the present disclosure includes a recombinant expression vector comprising as operably linked components:
  (i) a nucleic acid sequence capable of controlling expression in a host cell; and (ii) a nucleic acid sequence encoding CYP450, wherein the expression vector is suitable for expression in a host cell.

The present disclosure includes a recombinant expression vector comprising as operably linked components:
(i) a nucleic acid sequence capable of controlling expression in a host cell; and
(ii) a nucleic acid sequence encoding AKR, wherein the expression vector is suitable for expression in a host cell.

The present disclosure further includes a recombinant expression vector comprising as operably linked components:
(i) a nucleic acid sequence capable of controlling expression in a host cell; and
(ii) a nucleic acid sequence encoding CYP450 and AKR, wherein the expression vector is suitable for expression in a host cell. The term "suitable for expression in a host cell" means that the recombinant expression vector comprises the chimeric nucleic acid sequence of the present disclosure linked to genetic elements required to achieve expression in a host cell. Genetic elements that may be included in the expression vector in this regard include a transcriptional termination region, one or more nucleic acid sequences encoding marker genes, one or more origins of replication and the like. In preferred embodiments, the expression vector further comprises genetic elements required for the integration of the vector or a portion thereof in the host cell's genome, for example if a plant host cell is used the T-DNA left and right border sequences which facilitate the integration into the plant's nuclear genome.

Pursuant to the present disclosure, the expression vector may further contain a marker gene. Marker genes that may be used in accordance with the present disclosure include all genes that allow the distinction of transformed cells from non-transformed cells, including all selectable and screenable marker genes. A marker gene may be a resistance marker such as an antibiotic resistance marker against, for example, kanamycin or ampicillin. Screenable markers that may be employed to identify transformants through visual inspection include β-glucuronidase (GUS) (U.S. Pat. Nos. 5,268,463 and 5,599,670) and green fluorescent protein (GFP) (Niedz et al., 1995, Plant Cell Rep., 14: 403).

One host cell that particularly conveniently may be used is *Escherichia coli*. The preparation of the *E. coli* vectors may be accomplished using commonly known techniques such as restriction digestion, ligation, gel electrophoresis, DNA sequencing, the Polymerase Chain Reaction (PCR) and other methodologies. A wide variety of cloning vectors are available to perform the necessary steps required to prepare a recombinant expression vector. Among the vectors with a replication system functional in *E. coli*, are vectors such as pBR322, the pUC series of vectors, the M13 mp series of vectors, pBluescript etc. Typically, these cloning vectors contain a marker allowing selection of transformed cells. Nucleic acid sequences may be introduced in these vectors, and the vectors may be introduced in *E. coli* by preparing competent cells, electroporation or using other well known methodologies to a person of skill in the art. *E. coli* may be grown in an appropriate medium including but not limited to, Luria-Broth medium and harvested. Recombinant expression vectors may readily be recovered from cells upon harvesting and lysing of the cells. Further, general guidance with respect to the preparation of recombinant vectors and growth of recombinant organisms may be found in, for example: Sambrook et al., Molecular Cloning, a Laboratory Manual, Cold Spring Harbor Laboratory Press, 2001, Third Ed.

Further included in the present disclosure, are a host cell wherein the host cell comprises a chimeric nucleic acid sequence comprising as operably linked components one or more nucleic acid sequences encoding one or more of the polypeptides selected from the group consisting of CYP450 and AKR. As hereinbefore mentioned, the host cell is preferably a host cell not capable of naturally producing a benzylisoquinoline derivative, (S)-Reticuline, or (R)-Reticuline or a (R)-Reticuline precursor. In another embodiment, the host cell is naturally capable of producing (S)-Reticuline a benzylisoquinoline derivative but not (R)-Reticuline or an (R)-Reticuline precursor. In another embodiment, the host cell is able to produce a benzylisoquinoline derivative, (S)-Reticuline, or (R)-Reticuline or a (R)-Reticuline precursor, but the levels of (R)-Reticuline or the (R)-Reticuline precursor are lower than desirable and the levels of (R)-Reticuline or (R)-Reticuline precursor are modulated relative to the levels of (R)-Reticuline or (R)-Reticuline precursor in the native, unmodified cells. In embodiments wherein the cells are unable to naturally produce (S)-Reticuline or a benzylisoquinoline derivative, (S)-Reticuline or the benzylisoquinoline derivative may be provided to the cells as part of the cell's growth medium. In other embodiments, wherein the cells are unable to naturally produce (S)-Reticuline or a benzylisoquinoline derivative, a precursor compound of (S)-Reticuline or a benzylisoquinoline derivative capable of being converted by the cells into (S)-Reticuline or a benzylisoquinoline derivative, respectively, may be provided. Alternative substrates that may be provided to the cells as part of the cellular growth medium include, but are not limited to, (S)-Norcoclaurine, (S)—N-Methylnorcoclaurine, (S)-Norlaudanosaline, (S)—N-Methylnorlaudanosalin (5)-Coclaurine, (S)—N-Methylcoclaurine, (S)-3'-Hydroxycoclaurine, (S)-3'-Hydroxy-N-methylcoclaurine), (S)-Higenamine, (S)—N-Methylhigenamine, (S)-Laudanosoline, (S)-Norreticuline, (S)-Colletine, and (S)-Orientaline. Cells that may be used in accordance herewith include, without limitation, bacterial, yeast, or other fungal cells, plant cells, animal cells, or synthetic cells.

Further included in the present disclosure are compositions for epimerizing an (S)-enantiomer into an (R)-enantiomer, including an enzyme mixture comprising a first polypeptide capable of oxidizing a benzylisoquinoline derivative to an oxidized benzylisoquinoline derivative and a second polypeptide capable of reducing the oxidized benzylisoquinoline derivative to a (R)-Reticuline precursor, and further including an enzyme mixture comprising a first polypeptide capable of oxidizing (S)-Reticuline to form 1,2-Dehydroreticuline and a second polypeptide capable of reducing 1,2-Dehydroreticuline to form (R)-Reticuline. In preferred embodiments, the first polypeptide is a cytochrome P450 and the second polypeptide is an AKR.

In some embodiments, AKR and CYP450 polypeptides are operably linked to form a fusion polypeptide. Accordingly, further included in the present disclosure is a polypeptide comprising or consisting of SEQ. ID NO: 323.

The present invention further includes compositions comprising nucleic acid sequences encoding polypeptides capable of epimerizing an (S)-enantiomer into an (R)-enantiomer. In preferred embodiments, the nucleic acid sequences are a nucleic acid sequence encoding a CYP450 and an AKR, together capable of epimerizing an (S)-enantiomer into an (R)-enantiomer, and preferably capable of oxidizing a benzylisoquinoline derivative to an oxidized benzylisoquinoline derivative, and reducing the benzylisoquinoline derivative to (R)-Reticuline precursor, and more preferably capable of oxidizing (S)-Reticuline to form 1,2-Dehydroreticuline reducing 1,2-Dehydroreticuline to form (R)-Reticuline. In preferred embodiments, the nucleic acid sequence encoding AKR and CYP450 are operably linked to produce a CYP450-AKR fusion polypeptide. Accordingly further included in the present disclosure is SEQ. ID NO: 322.

The amounts of (R)-Reticuline that accumulates in the host cell may vary. In embodiments of the disclosure wherein the host cell naturally produces (R)-Reticuline and (S)-Reticuline (e.g. *Papaver somniferum* cells), the ratio of (R)-Reticuline to (S)-Reticuline synthesized in vivo by such cells prepared to comprise chimeric nucleic acid sequences in accordance with the present disclosure, exceeds the ratio of (R)-Reticuline to (S)-Reticuline present in the natural host cells (i.e. cells not comprising the chimeric nucleic acid sequences) or host cell extracts. Preferably the ratio of (R)-Reticuline to (S)-Reticuline in host cells or host cell extracts is greater than 21:79, e.g. at least 0.3:1, at least 0.4:1, at least 0.5:1, at least 1:1, at least 2:1, at least 3:1, or at least 4:1.

Use of (R)-Reticuline and (R)-Reticuline Precursors (R)-Reticuline obtained in accordance with the present disclosure may be formulated for use as a pharmaceutical drug, therapeutic agent or medicinal agent. Thus the present disclosure further includes a pharmaceutical composition comprising (R)-Reticuline prepared in accordance with the methods of the present disclosure. Pharmaceutical drug preparations comprising (R)-Reticuline in accordance with the present disclosure preferably further comprise vehicles, excipients, diluents, and auxiliary substances, such as wetting or emulsifying agents, pH buffering substances and the like. These vehicles, excipients and auxiliary substances are generally pharmaceutical agents that may be administered without undue toxicity. Pharmaceutically acceptable excipients include, but are not limited to, liquids such as water, saline, polyethyleneglycol, hyaluronic acid, glycerol and ethanol. Pharmaceutically acceptable salts can also be included therein, for example, mineral acid salts such as hydrochlorides, phosphates, sulfates, and the like; and the salts of organic acids such as acetates, propionates, benzoates, and the like. It is also preferred, although not required, that the preparation will contain a pharmaceutically acceptable excipient that serves as a stabilizer. Examples of suitable carriers that also act as stabilizers for peptides include, without limitation, pharmaceutical grades of dextrose, sucrose, lactose, sorbitol, inositol, dextran, and the like. Other suitable carriers include, again without limitation, starch, cellulose, sodium or calcium phosphates, citric acid, glycine, polyethylene glycols (PEGs), and combinations thereof. The pharmaceutical composition may be formulated for oral and intravenous administration and other routes of administration as desired. Dosing may vary and may be optimized using routine experimentation. The pharmaceutical composition comprising (R)-Reticuline may be used to treat baldness or muscle tension.

In further embodiments, the present disclosure provides methods for treating a patient with a pharmaceutical composition comprising (R)-Reticuline prepared in accordance with the present disclosure. Accordingly, the present disclosure further provides a method for treating a patient with (R)-Reticuline prepared according to the methods of the present disclosure, said method comprising administering to the patient a composition comprising (R)-Reticuline, wherein (R)-Reticuline is administered in an amount sufficient to ameliorate a medical condition in the patient. In preferred embodiments, the medical condition is selected from the group consisting of baldness and release of muscle tension.

Furthermore the (R)-Reticuline provided herein is useful as an agent to manufacture other secondary metabolites or medicinal compositions including, without limitation, salutaridine, codeine and morphine, and further including thebaine, papaverine, noscapine, codamine, laudine and laudanosine (+)-pallidine, (−)-isoboldine, and (−)-corytuberine.

The (R)-Reticuline precursors provided herein are useful as an agent to manufacture other secondary metabolites notably (R)-Reticuline. As illustrated in FIG. 1 (R)—N-methylcoclaurine may be used as an agent to manufacture (R)-3'-Hydroxy-N-methylcoclaurine. (R)-3'-Hydroxy-N-methylcoclaurine may be used as an agent to manufacture (R)-Reticuline.

Alternate Uses of Nucleotide Sequences Encoding AKR and CYP450 Polypeptides

In a further aspect, the nucleic acid sequences encoding AKR and/or CYP450 may be use to detect the presence or absence of the genes in a sample. Thus in one embodiment of the present disclosure, there is provided a method of detecting the presence or absence of a nucleic acid sequence encoding AKR and/or CYP450 comprising:
  (a) providing a sample suspected to comprise a nucleic acid sequence encoding AKR and/or CYP450; and
  (b) analyzing the sample for the presence of a nucleotide sequence encoding AKR and/or CYP450.

In a preferred embodiment, the sample comprises cells comprising genomic DNA. Thus in a preferred embodiment, there is provided a method of detecting the presence or absence of a nucleic acid sequence encoding AKR and/or CYP450 in a cell comprising:
  (a) providing a cell;
  (b) extracting genomic DNA from the cell; and
  (c) analyzing the genomic DNA for the presence of nucleic acid sequence encoding AKR and/or CYP450.

Methods to analyze genomic DNA are generally known to the art, and include, for example, the use of the polymerase chain reaction (PCR) and specific polynucleotide primers to amplify specific portions of the nucleotide sequence encoding AKR and/or CYP450. Further restriction digestion and Southern blot analysis may be used. The analysis may further be directed to introns, exons or regions upstream or downstream of the nucleic acid sequence encoding AKR and/or CYP450. The analysis further may be directed at identifying a genomic locus comprising a nucleic acid sequence encoding AKR and/or CYP450, wherein such locus is linked to modulated levels of expression of AKR and/or CYP450.

In preferred embodiments, the cell is a plant cell. In further preferred embodiments, the cell is plant cell obtained from a plant belonging to the plant families Papaveraceae, Lauraceae, Annonaceae, Euphorbiaceae or Moraceae, and more preferably, the plant belongs to the species *Papaver somniferum, Papaver bracteatum* or *Papaver rhoeas*.

In preferred embodiments, the CYP450 and/or AKR sequence used in order to perform the foregoing analysis is set forth in SEQ ID NOs: 116 to 218; XSEQ ID NO: 324; and SEQ ID NO: 337; or those set forth in SEQ ID NOs: 1 to 58; SEQ ID NO: 326; SEQ ID NO: 328; SEQ ID NO: 339; and SEQ ID NO: 341, or the sequence set forth in SEQ ID NO: 322.

In further aspects, the nucleic acid sequences encoding AKR and/or CYP450 may be used to produce a cell that has modulated levels of expression of AKR and/or CYP450. Such a cell is preferably a plant cell natively expressing AKR and/or CYP450 and, more preferably, a plant cell obtained from a plant belonging to the plant families Papaveraceae, Lauraceae, Annonaceae, Euphorbiaceae or Moraceae, and, most preferably, the plant belongs to the species *Papaver somniferum, Papaver bracteatum* or *Papaver rhoeas*. Thus the present disclosure further provides a method for modulating expression of nucleic acid sequences in a cell naturally expressing AKR and/or CYP450 comprising:

(a) providing a cell naturally expressing AKR and/or CYP450;
(b) mutagenizing the cell;
(c) growing the cell to obtain a plurality of cells; and
(d) determining if the plurality of cells comprises a cell comprising modulated levels of AKR and/or CYP450.

In preferred embodiments, the method further comprises a step (e) as follows:

(e) selecting a cell comprising modulated levels of AKR and/or CYP450 and growing such cell to obtain a plurality of cells.

In further preferred embodiments, plant seed cells are used to perform the mutagenesis. Mutagenic agents that may be used are chemical agents, including without limitation, base analogues, deaminating agents, alkylating agents, intercalating agents, transposons, bromine, sodium azide, ethyl methanesulfonate (EMS) as well as physical agents, including, without limitation, radiation, such as ionizing radiation and UV radiation. Thus the present disclosure further provides a method for producing a seed setting plant comprising modulated expression of nucleic acid sequences in a cell naturally expressing AKR and/or CYP450, the method comprising:

(a) providing a seed setting plant naturally expressing AKR and/or CYP450;
(b) mutagenizing seed of the plant to obtain mutagenized seed;
(c) growing the mutagenized seed into the next generation mutagenized plants capable of setting the next generation seed; and
(d) obtaining the next generation seed, or another portion of the mutagenized plants, and analyzing if the next generation plants or next generation seed exhibits modulated AKR and/or CYP450 expression.

In preferred embodiments, a plurality of generations of plants and/or seed may be obtained, and portions of plants and/or seed in any or all of such generations may be analyzed. Analysis is typically performed by comparing expression levels (e.g. RNA levels or protein levels) in non-mutagenized (wild type) plants or seed with expression in mutagenized plants or seed. In further preferred embodiments, the analysis in step (d) may be performed by analyzing heteroduplex formation between wildtype DNA and mutated DNA. Thus in preferred embodiments, the analysing in step (d) comprises i. extracting DNA from mutated plants;
ii. amplifying a portion of the DNA comprising a nucleic acid sequence encoding AKR and/or CYP450 to obtain amplified mutated DNA;
iii. extracting DNA from wild type plants;
iv. mixing the DNA from wild type plants with the amplified mutated DNA and form a heteroduplexed polynucleotide;

v. incubating the heteroduplexed polynucleotide with a single stranded restriction nuclease capable of restricting at a region of the heteroduplexed polynucleotide that is mismatched; and
vi. determining the site of mismatch in the heteroduplex polynucleotide.

In preferred embodiments, the nucleic acid sequence encoding AKR and/or CYP450 that is used is set forth in SEQ ID NOs: 116 to 218; SEQ ID NO: 324; and SEQ ID NO: 337; or those set forth in SEQ ID NOs: 1 to 58; SEQ ID NO: 326; SEQ ID NO: 328; SEQ ID NO: 339; and SEQ ID NO: 341; or the sequence set forth in SEQ ID NO: 322.

In further aspects, the nucleic acid sequences encoding AKR and/or CYP450 may be used to produce a cell that has modulated levels of expression of AKR and/or CYP450 by gene silencing. Thus the present disclosure further includes a method of reducing the expression of AKR and/or CYP450 in a cell, comprising:

(a) providing a cell expressing AKR and/or CYP450; and
(b) silencing expression of AKR and/or CYP450 in the cell.

In preferred embodiments, the cell is a plant cell. Preferably, the plant is a member belonging to the plant families Papaveraceae, Lauraceae, Annonaceae, Euphorbiaceae or Moraceae, and more preferably, the plant belongs to the species *Papaver somniferum, Papaver bracteatum* or *Papaver rhoeas*. A preferred methodology to silence AKR and/or CYP450 that is used is virus induced gene silencing (known to the art as VIGS). In general, in plants infected with unmodified viruses, the viral genome is targeted. However, when viral vectors have been modified to carry inserts derived from host genes (e.g. portions of sequences encoding AKR and/or CYP450), the process is additionally targeted against the corresponding mRNAs. Thus the present disclosure further includes a method of producing a plant expressing reduced levels of AKR and/or CYP450, the method comprising (a) providing a plant expressing AKR and/or CYP450; and
(b) reducing expression of AKR and/or CYP450 in the plant using virus induced gene silencing.

This aspect of the disclosure is further detailed in Example 5.

The hereinbefore mentioned methods to modulate expression levels of AKR and/or CYP450 may result in modulations in the levels of plant alkaloids in plants including, without limitation, morphine, codeine, thebaine, papaverine, noscapine, (S)-Reticuline, (R)-Reticuline, codamine, laudanine and laudanosine. The methods further may result in the modulation of the ratio of (S)-Reticuline, (R)-Reticuline. Preferably such modulation results in a ratio of (R)-Reticuline to (S)-Reticuline in plant cells or plant cell extracts of less than 21:79, more preferably less than 0.1, more preferably less than 0.05, more preferably less than 0.025 and more preferably less than 0.01. Such modulation is illustrated in Example 5. Thus the present disclosure includes the use of the methodologies to modify the levels of plant alkaloids in a plant naturally capable of producing plant alkaloids. Preferably, such plants belong to the plant families Papaveraceae, Lauraceae, Annonaceae, Euphorbiaceae or Moraceae, and more preferably, the plant belongs to the species *Papaver somniferum, Papaver bracteatum* or *Papaver rhoeas*.

In yet further aspects of the present disclosure, the nucleic acid sequences encoding AKR and/or CYP450 may be used to genotype plants. Preferably, the plant is a member belonging to the plant families Papaveraceae, Lauraceae, Annonaceae, Euphorbiaceae or Moraceae, and more preferably, the plant belongs to the species *Papaver somniferum, Papaver bracteatum* or *Papaver rhoeas*. In general, genotyping provides a means of distinguishing homologs of a chromosome pair and can be used to identify segregants in subsequent generations of a plant population. Molecular marker methodologies can be used for phylogenetic studies, characterizing genetic relationships among plant varieties, identifying crosses or somatic hybrids, localizing chromosomal segments affecting monogenic traits, map based cloning, and the study of quantitative inheritance. See, e.g., Plant Molecular Biology: A Laboratory Manual, Chapter 7, Clark, Ed., Springer-Verlag, Berlin (1997). For molecular marker methodologies, see generally, The DNA Revolution by Andrew H. Paterson 1996 (Chapter 2) in: Genome Mapping in Plants (ed. Andrew H. Paterson) by Academic Press/R. G. Landis Company, Austin, Tex., pp. 7-21. The particular method of genotyping in accordance with the present disclosure may involve the employment of any molecular marker analytic technique including, but not limited to, restriction fragment length polymorphisms (RFLPs). RFLPs reflect allelic differences between DNA restriction fragments caused by nucleotide sequence variability. As is known to those of skill in the art, RFLPs are typically detected by extraction of plant genomic DNA and digestion of the genomic DNA with one or more restriction enzymes. Typically, the resulting fragments are separated according to size and hybridized with a nucleic acid probe. Restriction fragments from homologous chromosomes are revealed. Differences in fragment size among alleles represent an RFLP. Thus, the present disclosure further provides a means to follow segregation of a portion or genomic DNA encoding AKR and/or CYP450, as well as chromosomal nucleic acid sequences genetically linked to these AKR and/or CYP450 encoding nucleic acid sequences using such techniques as RFLP analysis. Linked chromosomal nucleic sequences are within 50 centiMorgans (cM), often within 40 or 30 cM, preferably within 20 or 10 cM, more preferably within 5, 3, 2, or 1 cM of a genomic nucleic acid sequence encoding AKR and/or CYP450. Thus, in accordance with the present disclosure the AKR and/or CYP450 encoding sequences of the present disclosure may be used as markers to evaluate in a plant population the segregation of nucleic acid sequences genetically linked thereto. Preferably, the plant population comprises or consists of plants belonging to the plant families Papaveraceae, Lauraceae, Annonaceae, Euphorbiaceae or Moraceae, and more preferably, the plant population comprises or consists of plants belonging to the species *Papaver somniferum, Papaver bracteatum* or *Papaver rhoeas*.

In accordance with the present disclosure, the nucleic acid probes employed for molecular marker mapping of plant nuclear genomes selectively hybridize, under selective hybridization conditions, to a genomic sequence encoding AKR and/or CYP450. In preferred embodiments, the probes are selected from the nucleic acid sequences encoding AKR and/or CYP450 provided by the present disclosure. Typically, these probes are cDNA probes. Typically these probes are at least 15 bases in length, more preferably at least 20, 25, 30, 35, 40, or 50 bases in length. Generally, however, the probes are less than about 1 kilobase in length. Preferably, the probes are single copy probes that hybridize to a unique locus in a haploid plant chromosome complement. Some exemplary restriction enzymes employed in RFLP mapping are EcoRI, EcoRv, and SstI. As used herein the term "restriction enzyme" includes reference to a composition that recognizes and, alone or in conjunction with another composition, cleaves a polynucleotide at a specific nucleotide sequence.

Other methods of differentiating polymorphic (allelic) variants of the nucleic acid sequences of the present disclosure can be used by utilizing molecular marker techniques well known to those of skill in the art, including, without limitation: 1) single stranded conformation analysis (SSCP); 2) denaturing gradient gel electrophoresis (DGGE); 3) RNase protection assays; 4) allele-specific oligonucleotides (ASOs); 5) the use of proteins which recognize nucleotide mismatches, such as the *E. coli* mutS protein; and 6) allele-specific PCR. Other approaches based on the detection of mismatches between the two complementary DNA strands include, without limitation, clamped denaturing gel electrophoresis (CDGE); heteroduplex analysis (HA), and chemical mismatch cleavage (CMC). Thus, the present disclosure further provides a method of genotyping comprising the steps of contacting, under stringent hybridization conditions, a sample suspected of comprising a nucleic acid encoding AKR and CYP450, with a nucleic acid probe capable of hybridizing thereto. Generally, the sample is a plant sample; preferably, a sample suspected of comprising a *Papaver somniferum* nucleic acid sequence encoding AKR and/or CYP450 (e.g., gene, mRNA). The nucleic acid probe selectively hybridizes, under stringent conditions, to a subsequence of the nucleic acid sequence encoding AKR and/or CYP450 comprising a polymorphic marker. Selective hybridization of the nucleic acid probe to the polymorphic marker nucleic acid sequence yields a hybridization complex. Detection of the hybridization complex indicates the presence of that polymorphic marker in the sample. In preferred embodiments, the nucleic acid probe comprises a portion of a nucleic acid sequence encoding AKR and/or CYP450.

EXAMPLES

Hereinafter are provided examples of specific embodiments for performing the methods of the present disclosure, as well as embodiments representing the compositions of the present disclosure. The examples are provided for illustrative purposes only, and are not intended to limit the scope of the present disclosure in any way.

Example 1—Conversion of (S)-Reticuline to (R)-Reticuline

This Example demonstrates the in vitro conversion of (S)-Reticuline to (R)-Reticuline using an in enzyme mixture in the form of a fusion polypeptide of *Papaver somniferum* comprised of a CYP450 and an AKR moiety (SEQ. ID: NO 323).

*Saccharomyces cerevisiae* strain YPH499 harboring pESC-leu2d::PsCPR/PsREPI was grown and microsomes purified as described below. Briefly, the yeast strain was grown in Synthetic Complete (SC) medium lacking leucine supplemented with 2% glucose for 16 hours at 30° C. and 250 rpm. One milliliter of culture was added to 50 mL of SC medium lacking leucine, supplemented with 1.8% galactose, 0.2% glucose and 1% raffinose and grown for 72 hours at 30° C. and 250 rpm. Cultures were then centrifuged at 4,000 g for 5 minutes and washed with 5 mL of TEK buffer (50 mM Tris-HCl pH 8, 1 mM EDTA, 100 mM KCl). Pellets were resuspended in 1 mL TESB buffer (50 mM Tris-HCl pH 8, 1 mM EDTA, 0.6 M sorbitol) and an equal volume of 0.5 mm glass beads were added. The tubes were shaken by hand at 10° C. for 4 minutes. The beads were washed with TESB and the washings collected and centrifuged at 14,000 g for 10 min. The supernatant was ultracentrifuged for 1 hour at 125,000 g and the supernatant discarded. Microsomes were then resuspended in 50 mM HEPES pH 7.5.

Enzyme assays contained 500 µN NADPH and 50 µM of (5)-Reticuline in HEPES buffer (pH 7.5) and microsomes prepared as described above. Assays were incubated overnight at 30° C. Following the reaction, the assay samples were run on an Agilent 1260 HLPC at a flow rate of 0.2 ml/min and compounds were separated using a LUX cellulose-1 chiral column (150 mm×2.1 mm i.d.; Phenomenex) with 75% ammonium bicarbonate supplemented with 0.1% dethylamine (Solvent A) and 25% acetonitrile with 0.1% diethylamine (Solvent B). (R)-Reticuline and (S)-Reticuline were monitored at a wavelength of 284 nm.

Figure 3:
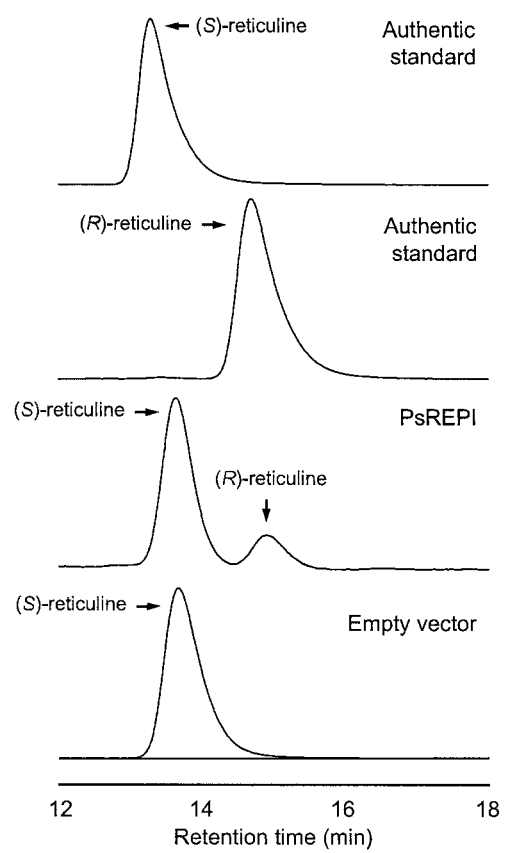
FIG. 3 depicts a series of HPLC traces of an embodiment of the disclosure providing the conversion of (S)-Reticuline to (R)-Reticuline as described further in Example 1.

Results are shown in FIG. 3. As can be seen in FIG. 3, the retention time of the authentic standard controls (R)-Reticuline and (S)-Reticuline on the chiral column is approximately 13.5 minutes (top panel); and 15 minutes (second panel from top), respectively. The bottom panel shows the results of an assay in which no enzyme is present in the mixture and demonstrates that under these reaction conditions no (S)-Reticuline is epimerized to (R)-Reticuline. The third panel from the top shows that in the presence of the enzyme mixture (5)-Reticuline is epimerized to (R)-Reticuline (see arrow, and appearance of peak at a retention time of approximately 15 min).

Example 2—Conversion of (S)-Reticuline to 1,2-Dehydroreticuline

This example demonstrates the in vitro conversion in yeast of (S)-Reticuline to 1,2-Dehydroreticuline using the CYP450 of *Papaver rhoeas* (SEQ. ID: NO 325). *Saccharomyces cerevisiae* strain YPH499 harboring pESC-leu2d::PsCPR/PrDRS was grown and microsomes purified as described below. Briefly, the yeast strain was grown in Synthetic Complete (SC) medium lacking leucine supplemented with 2% glucose for 16 hours at 30° C. and 250 rpm. One milliliter of this culture was added to 50 mL of SC medium lacking leucine, supplemented with 1.8% galactose, 0.2% glucose and 1% raffinose and grown for 72 hours at 30° C. and 250 rpm. Cultures were then centrifuged at 4,000 g for 5 minutes and washed with 5 mL of TEK buffer (50 mM Tris-HCl pH 8, 1 mM EDTA, 100 mM KCl). Pellets were then resuspended in 1 mL TESB buffer (50 mM Tris-HCl pH 8, 1 mM EDTA, 0.6 M sorbitol) and an equal volume of 0.5 mm glass beads were added. The tubes were shaken by hand at 10° C. for 4 min. The beads were washed with TESB and the washings collected and centrifuged at 14,000 g for 10 min. The supernatant was then ultracentrifuged for 1 hour at 125,000 g and the supernatant discarded. Microsomes were then resuspended in 50 mM HEPES pH 7.5.

Enzyme assays contained 500 µM NADPH and 50 µM of (5)-Reticuline in HEPES buffer (pH 7.5) and microsomes prepared as described above. Assays were incubated overnight at 30° C. Following the reaction, the assay samples were run on an Agilent 1260 HLPC coupled to a 6400 B mass spectrometer with an electronspray ionization source operating in positive mode. The mass spectrometer scanned from 200-400 m/z. Compounds were separated using the HLPC method for enzyme assays described previously (Farrow S C and Facchini, P J, (2013), J. Biol. Chem. (288) pp 28,997-29,012; dioxygenases catalyze O-demethylation and O,O-demethylation with widespread roles in benzylisoquinoline alkaloid metabolism in opium poppy).

Figure 4:
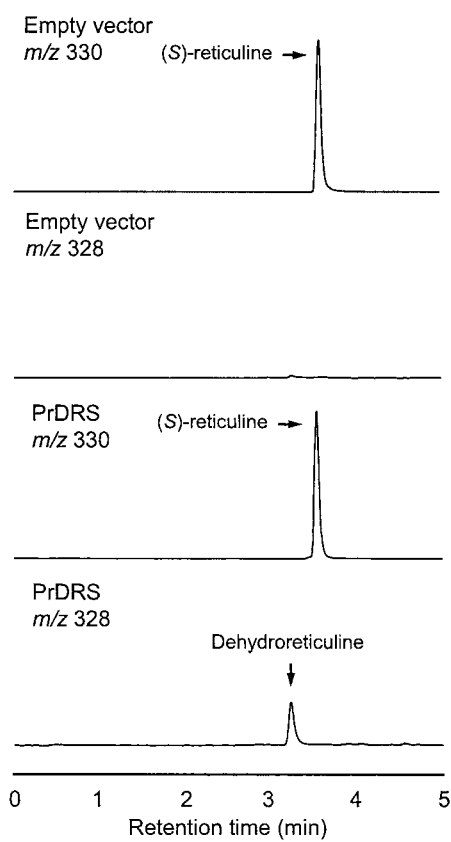
FIG. 4 depicts a series of HPLC traces of an embodiment of the disclosure providing the conversion of (S)-Reticuline to 1,2-Dehyrdoreticuline as described further in Example 2.

Results are shown in FIG. 4. As can be seen in FIG. 4 (top panel), a peak with a retention time of approximately 3.1 minutes is observed on the HPLC column in a control sample not comprising the enzyme. This peak corresponds with the predicted retention time of 3.13 minutes for the largest fragment of the collision-induced dissociation spectrum for (S)-Reticuline at m/z 330 (see: Table 1). The second panel from the top shows that no peaks are observed at m/z 328 in the same control sample, thus indicating the absence in the control sample of 1,2-Dehydroreticuline. The third panel from the top shows that a peak is observed at a retention time of approximately 3.1 minutes at m/z 330 in the sample comprising the enzyme, thus indicating the presence of (S)-Reticuline in the assay sample. The bottom panel shows that a peak having a retention time of approximately 3.0 is observed at m/z 328 in the assay sample. This peak corresponds with the predicted retention time of 3.02 minutes of the largest fragment of the collision-induced dissociation spectrum for 1,2-Dehydroreticuline at m/z 328 (see: Table 1) indicating the presence in the assay sample of 1,2-Dehydroreticuline in the presence of the enzyme.

Example 3—Conversion of 1,2-Dehydroreticuline to (R)-Reticuline

This example demonstrates the in vitro conversion in yeast of 1,2-Dehydroreticuline to (R)-Reticuline using AKR of *Papaver rhoeas* (SEQ. ID: NO 327).

A 16-hour, 50 mL LB supplemented with 50 µg/mL kanamycin monosulfate and 35 µg/mL chloramphenicol culture of *Escherichia coli* strain Rosetta (DE3) haboring pET47b::PrDRR was added to 1 L of the same media and grown at 37° C., 180 rpm until an OD600 of 0.6. IPTG was then added to a final concentration of 1 mM and allowed to grow at 25° C., 180 rpm for 4 h and the cell pellet was collected by centrifugation. Cells were lysed in buffer A (100 mM sodium phosphate buffer pH 7.0, 300 mM NaCl, 10% (v/v) glycerol) supplemented with 2 mM phenylmethanesulfonylfluoride (PMSF) with a French press. The cellular debris was removed by centrifugation at 14,000 g for 15 minutes. The total soluble protein extract was combined with buffer A-equilibrated TALON (Clonetech) resin for 45 minutes at 4° C., 65 rpm. The resin was washed twice with buffer A, and protein was eluted stepwise using a gradient of imidazole in buffer A (2.5, 10, 100, 200 mM). The purified protein was eluted in 100 mM imidazole.

Enzyme assays contained 500 µM NADPH, 50 µM of 1,2-Dehydroreticuline in sodium phosphate buffer (pH 7.0) and protein prepared as described above. Assays were left overnight at 30° C. Following the reaction, the assay samples were run on an Agilent 1260 HLPC coupled to a 6400 B mass spectrometer with an electronspray ionization source operating in positive mode. The mass spectrometer scanned from 200-400 m/z. Compounds were separated using the HLPC method for enzyme assays described previously (Farrow S C and Facchini, P J, (2013), J. Biol. Chem. (288) pp 28,997-29,012; dioxygenases catalyze O-demethylation and O,O-demethylation with widespread roles in benzylisoquinoline alkaloid metabolism in opium poppy).

Figure 5:
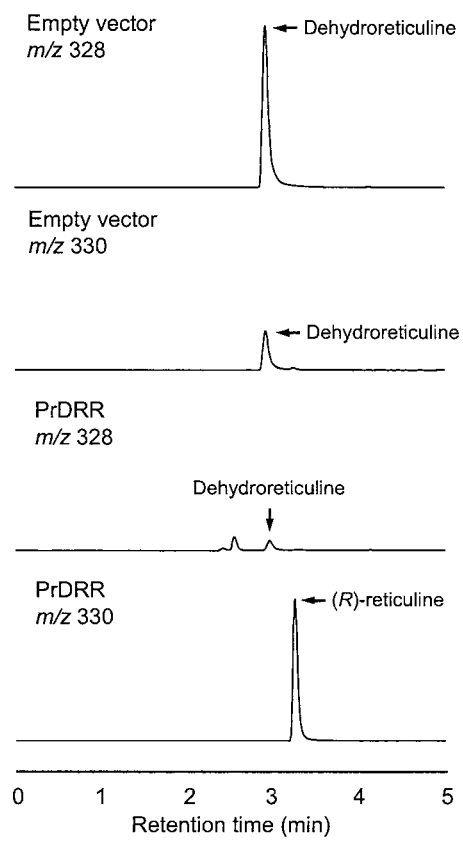
FIG. 5 depicts a series of HPLC traces of an embodiment of the disclosure showing the conversion of 1,2-Dehyrdoreticuline to (R)-Reticuline as described further in Example 3.

Results are shown in FIG. 5. As can be seen in FIG. 5 (top panel), a peak with a retention time of approximately 3.0 minutes is observed on the HPLC column in a control sample not comprising the enzyme. This peak corresponds with the predicted retention time of 3.02 minutes for the largest fragment of the collision-induced dissociation spectrum for 1,2-Dehydroreticuline at m/z 328 (see: Table 1). The second panel from the top shows no peak at a retention time of approximately 3.1 minutes is observed, thus (R)-Reticuline is absent in the sample. A small peak is observed at approximately 3.0 minutes in the same control sample. This peak represents an isotopic form of the substrate 1,2-Dehydroreticuline. The third panel from the top shows that a peak with a retention time of approximately 3.0 minutes is observed at m/z 328 in the sample containing the enzyme, thus indicating the presence of a small amount of unconsumed 1,2-Dehydroreticuline in the assay sample. The bottom panel shows that a peak having a retention time of approximately 3.1 is observed at m/z 330 in the assay sample. This peak corresponds with the predicted retention time of 3.13 minutes of the largest fragment of the collision-induced dissociation spectrum for (R)-Reticuline at m/z 330 (see: Table 1) indicating the presence in the assay sample of (R)-Reticuline in the presence of the enzyme.

Example 4—Conversion of (S)—N-Methylcoclaurine to (R)—N-Methylcoclaurine

This example demonstrates the in vitro conversion in yeast of (S)—N-methylcoclaurine to (R)—N-methylcoclaurine using an in enzyme mixture in the form of a fusion polypeptide of *Papaver somniferum* comprised of a CYP450 and an AKR moiety (SEQ. ID NO 2).

*Saccharomyces cerevisiae* strain YPH499 harboring pESC-leu2d::PsCPR/PsREPI was grown and microsomes purified as described below. Briefly, the yeast strain was grown in Synthetic Complete (SC) medium lacking leucine supplemented with 2% glucose for 16 hours at 30° C. and 250 rpm. One milliliter of culture was added to 50 mL of SC medium lacking leucine, supplemented with 1.8% galactose, 0.2% glucose and 1% raffinose and grown for 72 hours at 30° C. and 250 rpm. Cultures were then centrifuged at 4,000 g for 5 minutes and washed with 5 mL of TEK buffer (50 mM Tris-HCl pH 8, 1 mM EDTA, 100 mM KCl). Pellets were resuspended in 1 mL TESB buffer (50 mM Tris-HCl pH 8, 1 mM EDTA, 0.6 M sorbitol) and an equal volume of 0.5 mm glass beads were added. The tubes were shaken by hand at 10° C. for 4 minutes. The beads were washed with TESB and the washings collected and centrifuged at 14,000 g for 10 min. The supernatant was ultracentrifuged for 1 hour at 125,000 g and the supernatant discarded. Microsomes were then resuspended in 50 mM HEPES pH 7.5.

Enzyme assays contained 500 μM NADPH and 50 μM of (S)—N-methylcoclaurine in HEPES buffer (pH 7.5) and microsomes prepared as described above. Assays were incubated overnight at 30° C. Following the reaction, the assay samples were run on an Agilent 1260 HLPC at a flow rate of 0.2 ml/min and compounds were separated using a LUX cellulose-1 chiral column (150 mm×2.1 mm i.d.; Phenomenex) with 75% ammonium bicarbonate supplemented with 0.1% dethylamine (Solvent A) and 25% acetonitrile with 0.1% diethylamine (Solvent B). (R)- and (S)—N-methylcoclaurine were monitored at a wavelength of 230 nm.

Figure 6:
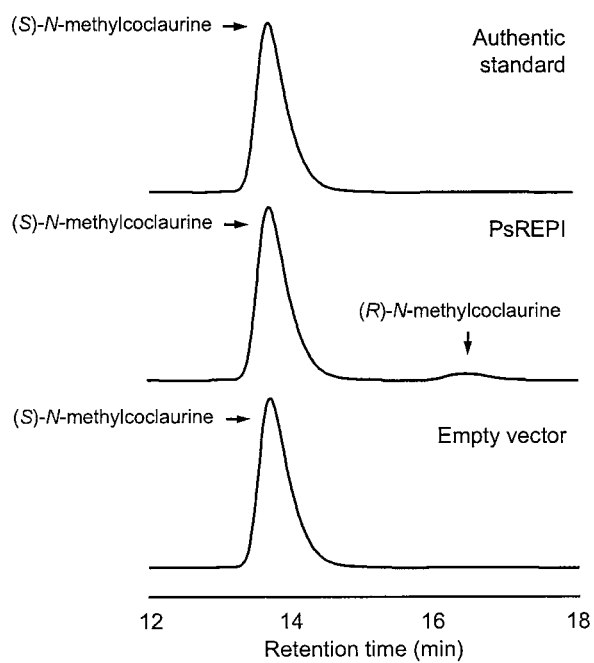
FIG. 6 depicts a series of HPLC traces of an embodiment of the disclosure showing the conversion of (S)—N-methylcoclaurine to (R)—N-methylcoclaurine as described further in Example 4.

Results are shown in FIG. 6. As can be seen in FIG. 6, the retention time of the authentic standard control (S)—N-methylcoclaurine on the chiral column is approximately 13.9 minutes (top panel). The bottom panel shows the results of an assay in which no enzyme is present in the mixture and demonstrates that under these reaction conditions no (S)—N-methylcoclaurine is epimerized to (R)—N-methylcoclaurine. The middle panel shows that in the presence of the enzyme mixture (S)—N-methylcoclaurine is epimerized to (R)—N-methylcoclaurine. (see arrow, and appearance of peak at a retention time of approximately 16.3 min)

Example 5—Gene Silencing of AKR and AKR-CYP450 Fusion Gene

This example show silencing of genes encoding the AKR and/or CYP450 using virus-induced gene silencing WIGS).

Figure 7A:
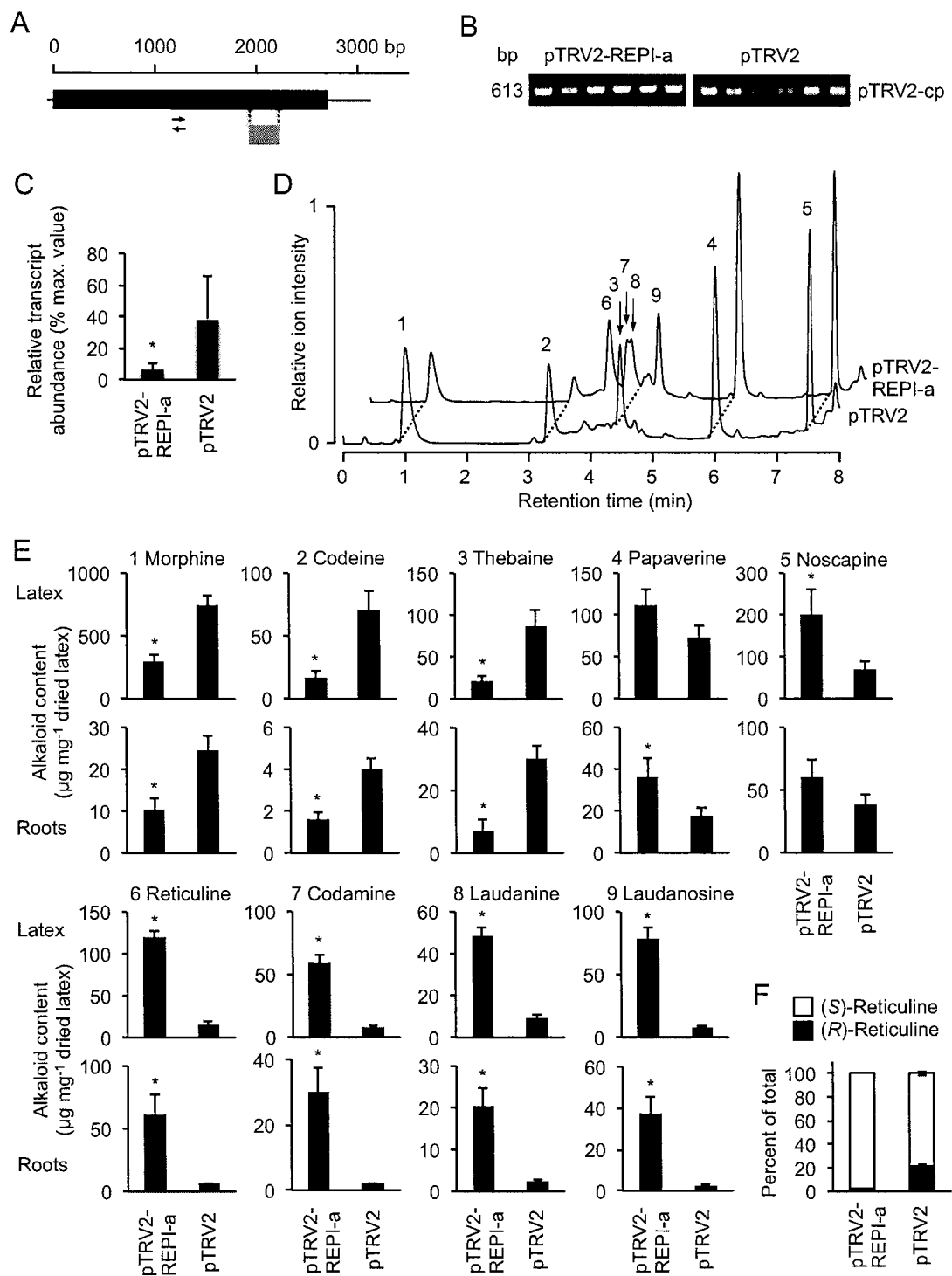
FIGS. 7A-C depict results obtained relating to a gene silencing experiment as further described in Example 5. Two different regions in the REPI gene were targeted (FIG. 7A.

REPI and/or COR1.3 (encoding codeinone reductase) transcript levels from opium poppy (*Papaver somniferum*) (transcribed by SEQ. ID. NO: 322 and SEQ. ID NO: 328, respectively) in the Bea's Choice chemotype of opium poppy (*Papaver somniferum*) were suppressed using the tobacco rattle virus (TRV) vector system. Two regions (REPI-a (FIG. 7A; Panel A) and REPI-5' (FIG. 7C; Panel A)) of the REPI cDNA and one region of the COR1.3 cDNA (FIG. 7B; Panel A) were amplified using the following primer pairs:

```
pTRV2-COR1.3
COR1.3-F,
ggatccCATCAGTTCCATGCTCTGGT

COR1.3-R,
ggtaccGGGCTCATCTCCACTTGATT pTRV2-REPI-a
REPI-a-F,
ggatccCATCACTTCCAAGCTCTGGT REPI-a-R,
ggtaccGGGCTCATCTCCACTTGAT pTRV2-REPI-5'
REPI-5'-F,
gaattcCCTACATACTGTATTGGGTTGAATCATG REPI-5'-R,
ggtaccTAACGGGATAGGACGGTTT
```

The REPI-a region and the COR1.3 region exhibit considerable similarity resulting in the reciprocal co-silencing of REPI and COR1.3 in each case. In contrast, the REPI-5' region is unique and result only in the silencing of REPI, but not COR1.3.

Figure 7B:
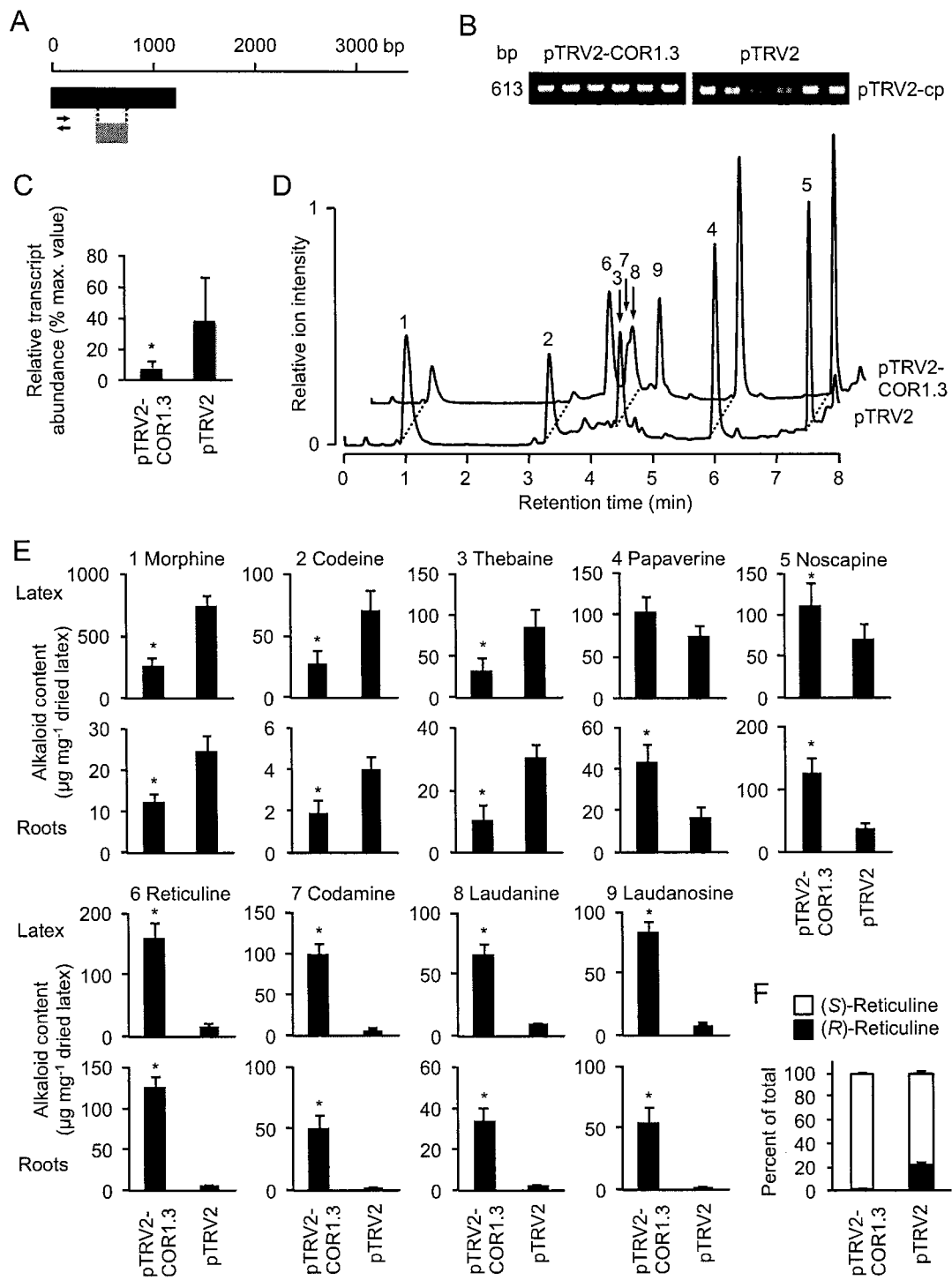
Figure 7C:
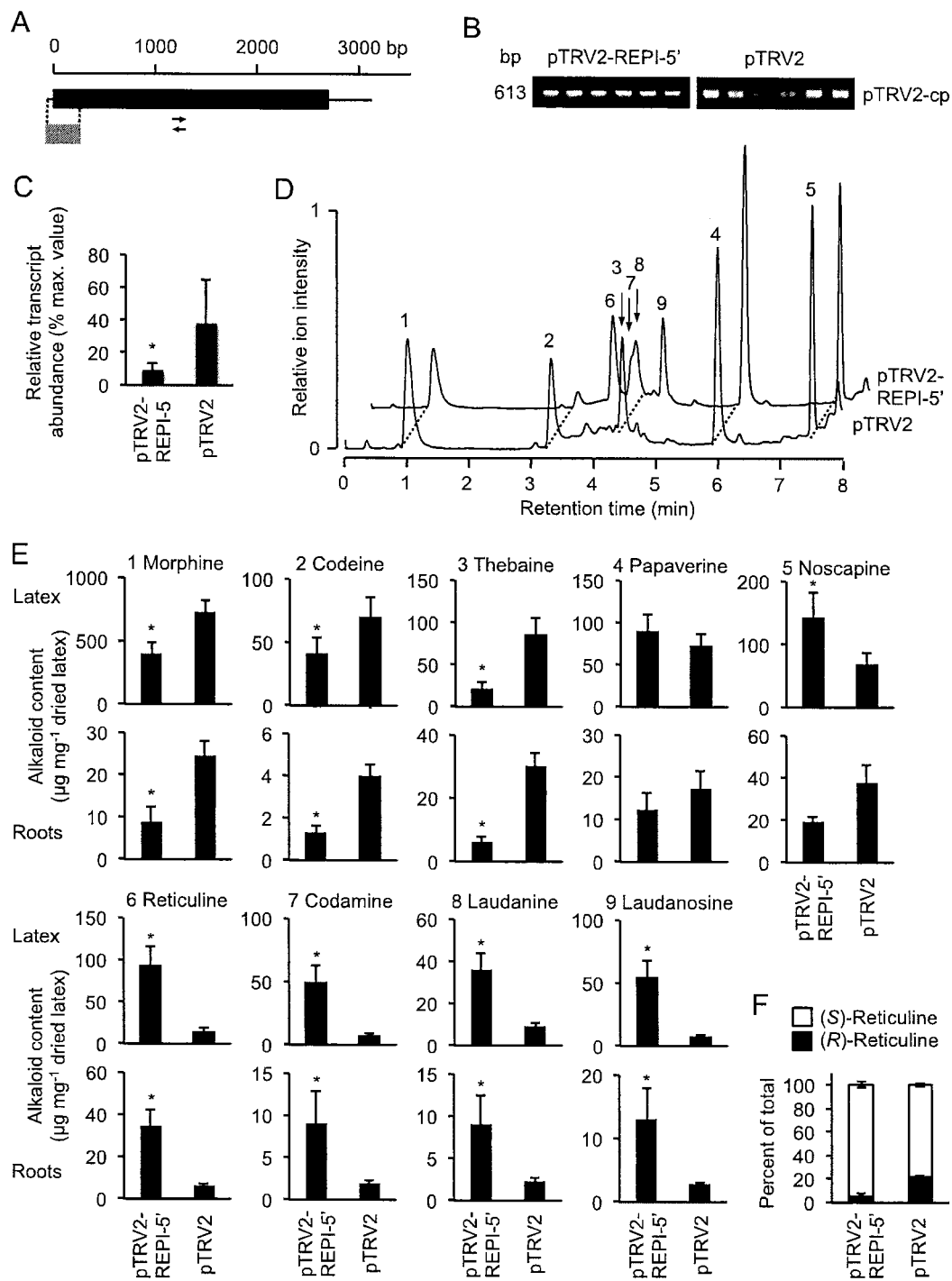

Amplicons were individually cloned into pTRV2 and vectors were mobilized in *Agrobacterium tumefaciens* as described previously. Apical meristems of two to three week-old seedlings were infiltrated with a 1:1 mixture of *A. tumefaciens* harboring pTRV1 and constructed pTRV2 containing the gene-specific fragments. Empty pTRV2 was used as a negative control and the pTRV2-PDS construct encoding phytoene desaturase was used as a positive infiltration control. Infiltrated plants were cultivated in the greenhouse for 8-10 weeks. Infiltration with *A. tumefaciens*, and collection and processing of latex, stem and root samples for alkaloid and transcript analyses were performed as described previously. Typically, 20-30 plants were infiltrated with *A. tumefaciens* harboring pTRV1 and one pTRV2 construct. In approximately 70-80% of the infiltrated plants, a mobilized fragment of the pTRV2 construct was detected by RT-PCR (FIG. 7A (Panel B); FIG. 7B (Panel B); FIG. 7C, Panel B), showing that these plants were successfully infected. Alkaloids were extracted from lyophilized latex using methanol. Relative transcript abundance was determined by qRT-PCR (FIG. 7A (Panel C); FIG. 7B (Panel C); FIG. 7C, Panel C). Alkaloid content and relative transcript abundance data were generated from 6 individually infiltrated plants, and three technical replicates were performed on each sample. Latex samples for infiltrated plants were analysed by LC-MS/MS. Effects on the alkaloid content of opium poppy plants infiltrated with *A. tumefaciens* harboring pTRV1 and each of 2 regions of REPI or COR1.3 in separate pTRV2 constructs were assessed using total ion chromatograms (FIG. 7A (Panel D); FIG. 7B (Panel D); FIG. 7C, Panel D) and by determining the relative abundance of 9 different alkaloids (morphine, codeine, thebaine, papaverine, noscapine, codamine, laudine and laudanosine) in latex and roots (FIG. 7A (Panel E); FIG. 7B (Panel E); FIG. 7C, Panel E). In addition to lower morphine content, silencing of REPI or COR1.3 caused significant reduction in the levels of codeine and thebaine. Silencing of REPI (i.e. the AKR-CYP450 gene) as well as silencing of COR1.3 (i.e. the AKR gene) resulted in significant increase in the accumulation of reticuline, codamine, laudanine, laudanosine, and less consistently papaverine and noscapine. The ratio of (R)-reticuline to (S)-reticuline was approximately 21:79 in the latex of control (pTRV2) plants, but the ratio of (R)-reticuline to (S)-reticuline decreased to approximately 2:98 in the latex of pTRV2-REPI-a plants (FIG. 7A (Panel F) and pTRV2-COR1.3 plants; FIG. 7B (Panel F); and to approximately 5:95 in the latex of pTRV2-REPI-5' plants in latex and roots (FIG. 7C, Panel F).

Example 6—Catalytic Activity of AKR in the Presence of NADPH/NADH and NADP$^+$/NAD$^+$ This Example shows the conversion of 1,2-Dehydroreticuline into (R)-Reticuline catalyzed by AKR polypeptide in the presence of the reducing agents NADH or NADPH. This Example further shows reversibility of the foregoing reaction in the presence of the oxidizing agents NAD$^+$ or NADP$^+$.

Figure 8A:
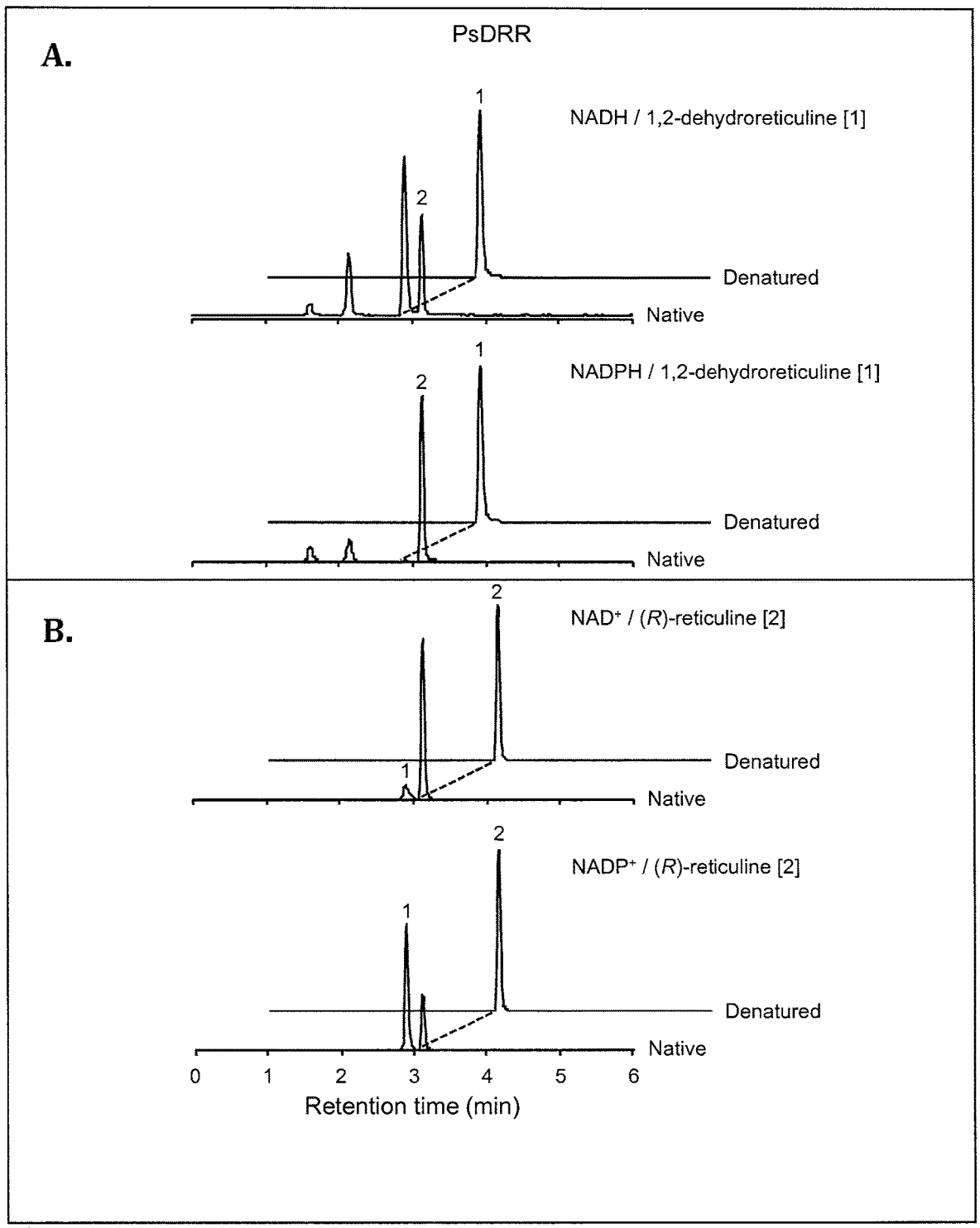
FIGS. 8A-B depict the results obtained when evaluating the activity of AKR polypeptide in the presence of reducing and oxidizing agents, as further described in Example 6.
Figure 8B:
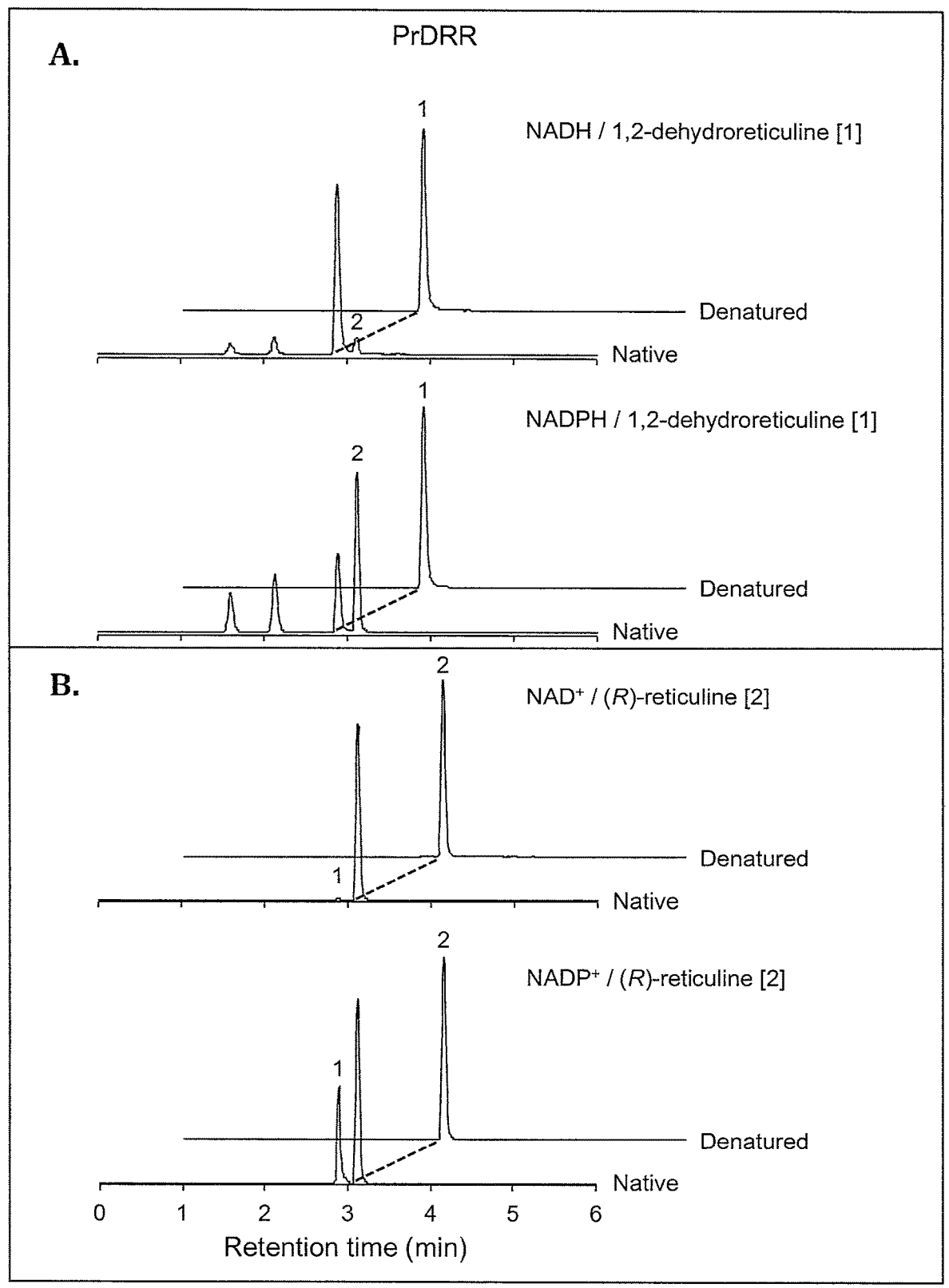

Experiments were performed essentially as described in Example 3 above, except that the reactions were performed using AKR obtained from *Papaver somniferum* and from *Papaver rhoeas*, and that in the reverse reaction (R)-Reticuline was provided as the substrate, and either NAD$^+$ or NADP$^+$ was used as oxidizing agent to perform the enzymatic reaction. The last mentioned reaction was conducted at pH 9. As shown in FIG. 8, both in the presence of NADH and NADPH 1,2-Dehydroreticuline is, using catalytic quantities of the AKR polypeptide of both *Papaver somniferum* (PsDRR) (FIG. 8A, Panel A) and from *Papaver rhoeas* (PrDRR) (FIG. 8B, Panel A), converted to (R)-Reticuline. As further shown in FIG. 8, using both the *Papaver somniferum* AKR polypeptide PsDRR (FIG. 8A, Panel B) and the *Papaver Rhoeas* polypeptide PrDRR (FIG. 8B, Panel B) the reaction can be reversed, and in the presence of NAD$^+$ or NADP$^+$ (R)-Reticuline is converted into 1,2-Dehydroreticuline.

Example 7—pH Dependence of AKR Activity

This Example shows the pH dependence of AKR polypeptide both in the presence of reducing agent and oxidizing agent.

The pH dependence of both *Papaver somniferum* and *Papaver rhoeas* CYP450 and AKR polypeptides was examined. Enzymatic reactions were conducted essentially as described in Example 3 and Example 6, except that the pH in each reaction was incrementally increased from pH 3.5 to pH 10. The enzyme activity at each evaluated pH was quantitated by analysis of samples on an Agilent 1260 HLPC coupled to a 6400 B mass spectrometer with an electrospray ionization source operating in positive mode. The mass spectrometer scanned from 200-400 m/z. Compounds were separated using the HLPC method for enzyme assays described previously (Farrow S C and Facchini, P J, (2013), J. Biol. Chem. (288) pp 28,997-29,012; dioxygenases catalyze O-demethylation and O,O-demethylation with widespread roles in benzylisoquinoline alkaloid metabolism in opium poppy).

Figure 9:
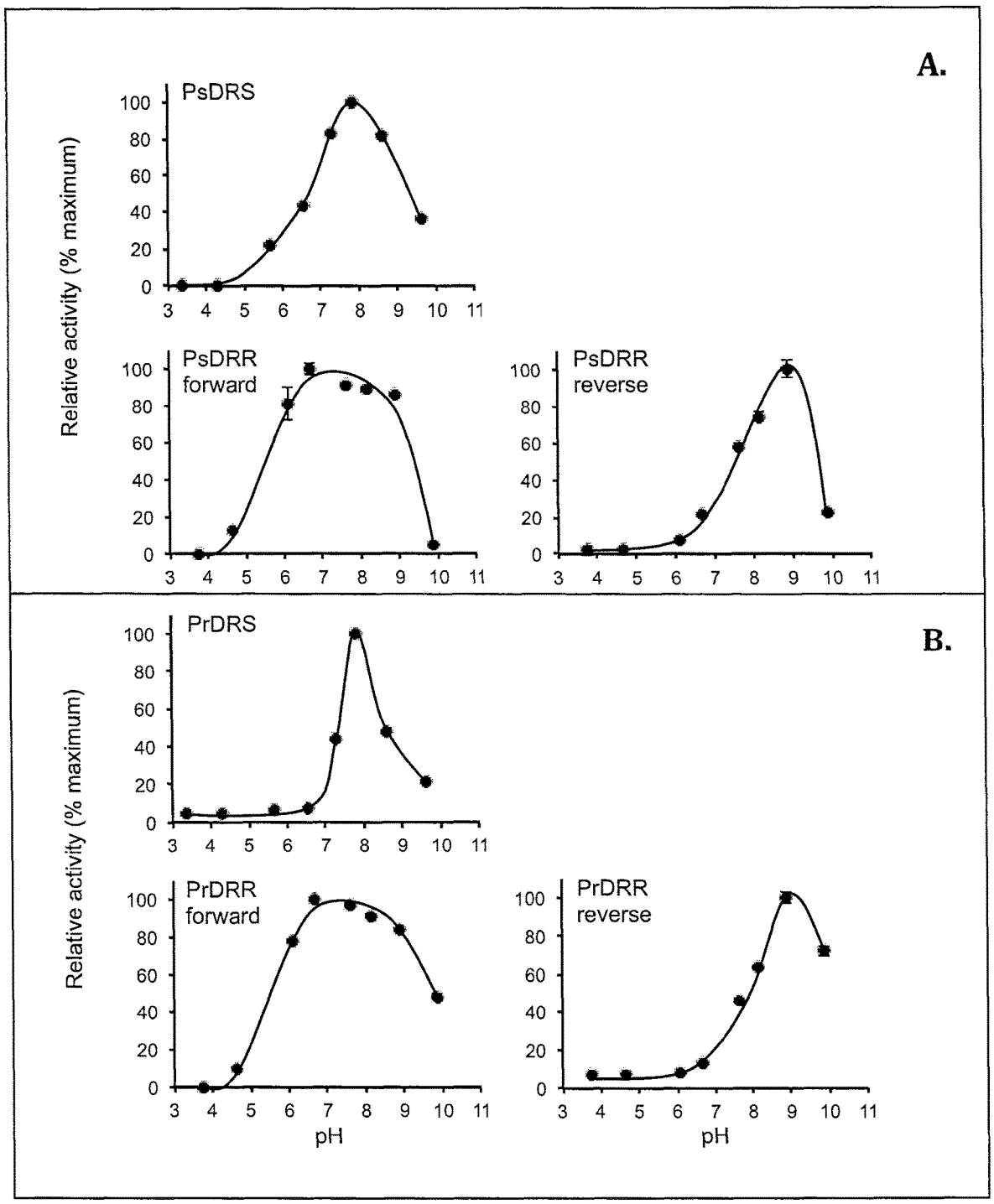
FIG. 9 depicts the results obtained when evaluating the pH dependence of CYP450 and AKR polypeptide as further described in Example 7. Shown are the results obtained using *Papaver somniferum* CYP450 (PsDRS) and AKR in the presence of NADPH (PsDRS forward) and in the presence of NADP+ (PsDRS reverse) (Panel A). Further shown are the results obtained using *Papaver rhoeas* CYP450 (PrDRS) and AKR in the presence of NADPH (PrDRS forward) and in the presence of NADP+ (PrDRS reverse) (Panel B).

The results are provided in FIG. 9. Shown in Panel A are graphs showing enzymatic activity as a function of pH using *Papaver somniferum* CYP450 (PsDRS) and AKR in the presence of NADPH (PsDRS forward) and in the presence of NADP$^+$ (PsDRS reverse). Shown in Panel B are graphs showing enzymatic activity as a function of pH using *Papaver rhoeas* CYP450 (PrDRS) and AKR in the presence of NADPH (PrDRS forward) and in the presence of NADP$^+$ (PrDRS reverse). As can be seen in FIG. 9, PsDRS and PrDRS convert (S)-Reticuline to 1,2-Dehydroreticuline at an optimum of approximately pH 8. In the presence of NADPH, PsDRR and PrDRR convert 1,2-Dehydroreticuline to (R)-Reticuline at an optimum of approximately pH 7. In the presence of NADP$^+$, PsDRR and PrDRR convert (R)-reticuline to 1,2-Dehydroreticuline at an optimum of approximately pH 9.

Example 8—Gene Silencing of AKR and AKR-CYP450 Fusion Gene

This example show further silencing of genes encoding the AKR and/or CYP450 using virus-induced gene silencing (VIGS).

Figure 10:
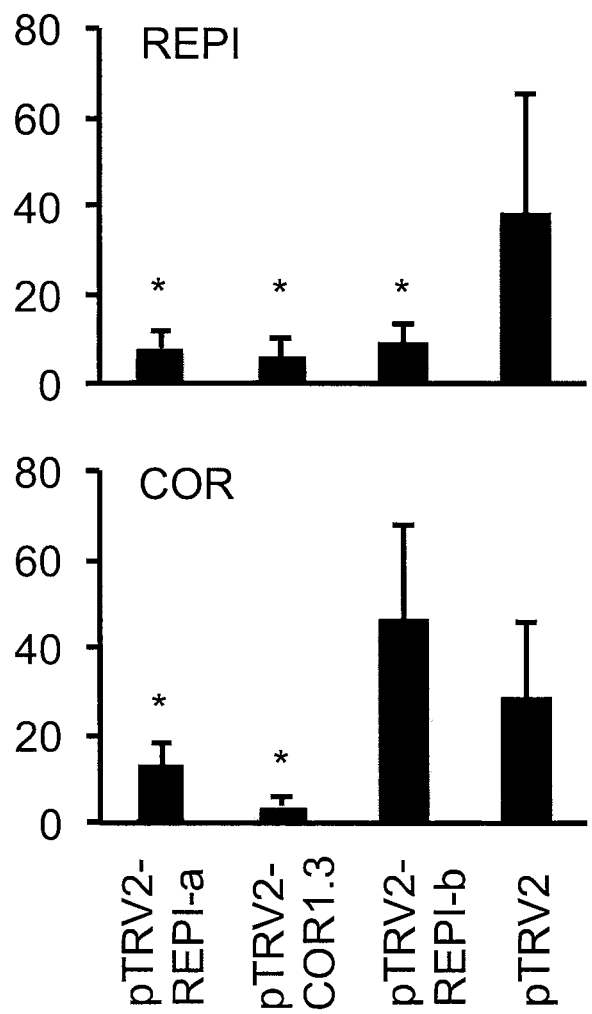
FIG. 10 depicts the co-suppression of REPI and COR transcript levels in opium poppy plants subjected to virus-induced gene silencing (VIGS) as further described in Example 8. Plants in which the silencing of COR is targeted (pTRV2-COR1.3) showed significant suppression of COR (FIG. 10—bottom panel), and additionally showed suppression of REPI (FIG. 10—top panel). Plants in which the silencing of REPI was targeted using a conserved region found in both REPI and COR (pTRV2-REP1a) also showed significant suppression of COR (FIG. 10—bottom panel) and REPI (FIG. 10—top panel). Plants in which the silencing of REPI was targeted using a unique region of REPI (pTRV2-REP1b), a region not also found in COR, did not show the co-silencing of COR (FIG. 10—bottom panel). pTRV2 is the empty vector control. Asterisks indicate values that are significantly different compared with controls using and unpaired, Student's t-test (P<0.05). Error bars represent the mean±standard deviation.

Gene silencing experiments were conducted essentially as described in Example 5, except that the COR (AKR) and REPI (CYP450) genes were targeted using the following constructs: REPIa, REPIb and COR.1.3. REPIa represents a construct that targets a sequence conserved in both the COR gene and the REPI gene. By contrast, REPIb targets a region that is unique to REPI. COR 1.3 targets a region that is unique to COR. Transcript levels of REPI and COR were determined as described in Example 5. An empty vector was used as control (PTRV2) As can be seen in FIG. 10, plants in which REPI is uniquely targeted through REPIb display decreased levels of REPI transcript relative to the control (FIG. 10—top panel), while COR transcript levels remain substantially the same (FIG. 10—bottom panel). Plants in which REPI and COR are both targeted through REPIa display reduced transcript levels of REPI (FIG. 10—top panel) and COR (FIG. 10—bottom panel). When COR was targeted using COR1.3, COR transcript levels were diminished (FIG. 10—bottom panel). In addition, REPI transcript levels also decreased relative to the control (FIG. 10—top panel) in response to silencing of COR transcript levels by COR1.3.

TABLE 1

| Compound (HPLC column) | Retention time (min) | Collision-induced dissociation spectrum | Collision energy (eV) | $\lambda_{max}$ (nm) |
| --- | --- | --- | --- | --- |
| (R)-Reticuline (chiral column) | 13.5 | NA | NA | 284 |
| (S)-Reticuline (chiral column) | 15.0 | NA | NA | 284 |
| (S)-Reticuline (C18 column) | 3.13 | 330.2 (10), 210.1 (6), 192.1 (100) 177.1 (4), 175.1 (14), 151.2 (4) 143.1 (16), 137.1 (38) | 25 | NA |
| (R)-Reticuline (C18 column) | 3.13 | 330.1 (30), 210.1 (31), 192.1 (100) 175.1 (16), 142.9 (17), 136.9 (28) | 25 | NA |
| Dehydroreticuline (C18 column) | 3.02 | 328.3 (100), 313.2 (83), 312.2 (80) 296.4 (6), 284.2 (26), 252.1 (5) 190.2 (4), 162.4 (7) | 25 | NA |

SEQUENCE LISTING (341 sequences)

SEQ ID NO: 1 - DNA, 966 bp, Papaver somniferum
atggagagtaatggtgtacctatgatcactctcagttccggcattcggatgcctgctttaggtatgggaacagctgaaacaatggtaaaaggaacagaaagagagaaattggcgtttttgaaagcgatagaggtcggttacagacacttcgatacagctgctgcataccaaactgaagagtgtcttggtgaagctatagctgaagcacttcaacttggtctaataaaatctcgagatgaactcttcatcacttccaagctctggtgcgctgatgctcacgctgatcttgtcctccctgctcttcagaattctctgaggaatcttaaattggactatcttgatctatatttgatacaccatccggtaagcttgaagccagggaagtttgttaacgaaataccaaaggatcatatccttccaatggactacaaatctgtatgggcagccatggaagagtgtcagacccttggcttcactagggcaatcggggtctgtaatttctcatgcaaaaggcttcaagagttgatggaaacagccaacagccctccagttgtgaatcaagtggagatgagcccgactttacatcaaaaaaatctgagggaatattgcaaggccaataatatcatgatcaccgcacactcagttttgggagccgtaggtgccgcctggggcaccaatgcagttatgcattctaaggtgcttcaccagattgctgtggccagaggaaaatctgttgcccaggttagtatgagatgggtttaccagcaaggcgcgagtcttgtggtgaaaagtttcaatgaagcgaggatgaaggaaaaccttaagatatttgattgggaactaacggcagaagacatggaaaagatcagtgagattccacaatctagaacaagctctgctgctttcttgttatcaccgactggacctttcaaaactgaagaagagttctgggatgagaaggattga

SEQ ID NO: 2 - DNA, 978 bp, Argmenone mexicana
atggaggaagttattggcttggaaactgtggttccaaaagtaaccctaagtagtagttcaggtgacaattccatgccagtaataggttttgggacagctgcatctccaatggctgatcatgaaattacgaaagctgctgttctcgttgggatcgaaaatggttatcgtcacttcgatactgccgctgcttatggaacggaaaaggctgttggtgaagccatagctgaagccctacgtctcggtttgatcaaatctcgagctgaagtttttattactactaaactttggtgtagaagttgcgaacgtgaccttgttgtcccctcactcaagaatagcctccaggatttacaaacggattacgtagatcttttcctcatacattggccagtgagactacgtcatgacgcaggacgacctcctatttcgagagaccaaatcctaacttttgatacaaaatcagtttgggaaggaatggaagaatgtcatgaattagggctcgcaaaaaatatcggagttagtaacttttctatcaagaagctcgaagaattactagccacggcaaagattcccccggtgctcgatcaagtggaactgagcccaacttggcaccagaagaatctgatcgagtattgtaaggaaaagggtattcatgtaacggcttattcagctttaggagccaataacacacattggggaaacaatcgagtcgtggagagtgatgtgttaggtgagatagctaaggctcggggaaaaactacagctcagatcgcattgagatgggtatatgagcaaggtgtgagtatggtggtcaagagttttaaccaagaaaggatgaaacaaaaccttcagatcttcgattttgagttaactgaagaagagtcaaataaaatcagtcaatttccacagcacaaaggagtaagcctgtctgcagtttatggtgatcatgatatactcaaggagatggaagctgaactttga

SEQ ID NO: 3 - DNA, 969 bp, Argmenone mexicana
atggagaatgtaattcctagagtgacattgagctctggaagtgtgatgcctatattaggtatgggtacagcatcatacccatttgttagttcagaagaagggaaattggcaatactgaatgcaatcaaagtaggttatagacactttgatacagcttctacttacatgtttgaggagtttcttggtgaagctatagctgaagcaattcaacttggactgatcaaatcccgtaaagaactgttcattacttccaaattatggtgctgcgatgctcatcctgatcttgtcgttccttctcttcgaaactcattacggaatcttaagttggagtaccttgatttatatctgatacactttccagtaagcttgaaggcagggaggtatgagtatccacccctaaaggaagctttagttctgatggattacaagtctgtatgggcagccatggaagagtgccaaaatcttggccttaccaagtcaattggtgtaagcaacttctcttgcaagaagcttcaaactattttggactatgccaaaatccctccctcagttaatcaagtggagatgaatccagtttggcaacagaagaaactgagagaattttgcaaggccaacgatattgttatcactgcttactcacctttaggagctagtggaaccccgtggggatcgagcagagtacttgatgcacaagttctgcatgaaattgctagggctaaagggaaaactcatgctcaggtttgtttgagatgggtatacgaacaaggagtgagtttgcttgtaaagaccttcaatgaagagaggatgaaggaaaacctaaggatatttgactgggaactgactgaagaagataagcaaaagatcagtaaaataccacagcatagaggactgactggtgatgcttttgtctcagaacatgaaggggcacccttcaagactgcagaagagttatgggatggagaagtttga

SEQ ID NO: 4 - DNA, 969 bp, Argmenone mexicana
atggatatgaataaacatgcggttgtttatgttccaacaaaagtcatcatggggattccagtgattggctttggtacatcagctgatccccctgtcgactttgatacgactaggctggcaattatgcaagctattgaaaatggttacaggcattttgatacagctgctctttataactcggaacagcctcttggtgaagctattaacgaagccattagtcgtggattgattaaatctcgagatgaacttttcatcacttccaaattatggtgcagcgatacccatccacaacatattcttcctgccatacaaaagactctcagaaatctgaatatggagtatcttgatctgtatcttatccactggccagtgagttcgaggcacgaaaattttgaatatccgataaagaaagaagattttcttcctatggattttaagaaagtgtgggccgcaatggaagaatgtcataaacaggggctcgcaaagtttattggagtcagcaatttctcttgcaagaaacttgacaatatcatggcctctgcaacaatttccccttcagttcttcaagtggaagtaaatccatgttggcaacaaaaaaggttgatagatttttgcaaagctaatggaatatttgtagttgcttatgctcctttaggagcagtggggacaatttatggaactaatagagttatggaatctgatgttctcaagcaaattgccaagaaaagaggaaaaagtgttgcacaggtttgtttgagatgggcatatgagcaaggcattggtgtggtggtgaaaagctttaacaaggagaggatgaagcagaaccttgaaatattcgattggaaactgagtgaagaggatacgaagaaaattagtgaaattcaacaagatcgagcttgtcttggaatggattatacatcaccatatggaccttacaagacaataaaacaactatgggatgaagagtaa

SEQ ID NO: 5 - DNA, 969 bp, Berberis thunbergii
atggaaattgttcctaaagtgacattgaattctggctatcaaatgcctcttttaggcttcggaacagccgaaaattggccgtttaccaaatctgaagcagccaaacgggcaatactgtgtgcaatcaagaatggctacagacactttgacacagcttccatgtaccaatcagaggagtcacttggtgaagctatagtcgaagcgcttcaccttggccttatcaaatctcggaatgaactcttcatcacttccaagctatggtgtagtgattgtcaccaagatcgcgttctccctgcccttagggagactctcaagaatcttcacttggattaccttgatctttacctcatacattggccgctaagcgcaaagccagggaagcatgagtacccaatactaaaagataagcttcttcctatggactatgaatccgtatggggagcaatggaagaatgccagaggcttggcctctctaagtccattggagtcagcaacttctctagcaagaagctggaacagctactcaaaactgcaaagattattcctgcagttaatgaagtggaagtgaaccctgtttggcatcaaaataagctaatagagttctgtaaggccaaaggtattgttgtgactggttactctcctttaggtgccaaaggaacaacttggggaaccaataaagtcatggacagtgaggtcctgaaagagattgctaagactagaggaaagacacatgctcaggtttgtctgagatggatatacgagcaaggagttggcctggtggcgaagagctttaatgaagagaggatgaaggagaatttggagatatttgattgggcattgactgaagaagagtccaaacagatcagccagttaccacaatataaagggcaaaatggagaaacgtttctctcagctgaagggcctttcaagaccttagaggagctatgggatgaagaggtagcagcttga

SEQ ID NO: 6 - DNA, 963 bp, Berberis thunbergii
atggaaattgttcctaaagtgacattgaattctggctatcaaatgcctcttttaggcttcggaacagccgaaaattggccgtttaccaaatctgaagcagccaaacgggcaatactgtgtgcaatcaagaatggctacagacactttgacacagcttccatgtaccaatcagaggagtcacttggtgaagctatagtcgaagcgcttcaccttggccttatcaaatctcggaatgaactcttcatcacttccaagctatggtgtagtgattgtcaccaagatcgcgttctccctgcccttaagaacacactccagaatcttcaactggattaccttgatctttaccttattcattttccgctgagttcaaagcgaggtaaacttgagtatccactacaggaagacgagacctatcccatggatttcggatctgtatgggaagagatggaaaagtgccaaagggttggtctcaccaaatccattggagtcagcaatttctctgctaagaagattgaacacctactcacgaccgcaaagattatccccgccgttgatcaagttgagatgaatccattgtggcaacaaaggactctgagagagtattgtaagaccaaaggtatcgttgtgacagcttactcacctttaggtgccaaaggtgcaatttggggatccaatatcgttatggagaatgaggtgctagcagagattgctaaggctaaaggaaagacccatgctcaggtatgtctgagatcagtgtacgaaaaaggcgttgcattggtaacgagaagctacaatgaagaaaggatgaagcagaatctaaacatatttgattggaacttgagcaaagaagagaccaaacgtatcgacaacttgccacaaaaaagagtcttccttggagaaggatttctgtctcccctaggacccttcaagtctccagaggaactatgggatggagagatgtga

SEQ ID NO: 7 - DNA, 975 bp, Corydalis chelantifolia
atgatggtgagtgttcctgaggtgacactgcagagtagttccagtgataaaaagatgcctattatgggcatgggcactgcagcctatcctttcgccgaatcagatgaagcaaaggctgcactcttaacttcaatcaagcttggttacagacattttgatacagcttcactgtaccacaatgagaagtctgtaggtaaagctatatctgaggctcttaaactcggactcgtcaaatctcgagatgaattctacatcaactccaagctatggtgctctgattctcacccagaccgagtcatccctgcccttcaagagtcactcaagaagcttgggttggagtaccttgatatgtatcttattcattggccattgagcttgaagaaagggagttatgagttccctataccaacggacgaggaaatactacctatggacttcaaggcagtatgggcagccatggaggagtgccaaaagcttggcctcactaagtccattggtgtcagcaacttttcttgtaagaagcttgaaacaattctctctacggccaagatacctcctgttgttaatcaggtggagttgaacacactttggcaacagacgaaactaaacaaattttgtaaggacaatggtatcgttcttatggcattttcccctttgggagctcacggaagtccttggggaacaaaccgtgttatggaatgcgagttacttcatgagattgcaaaggcaaaaggaaagactcttgctcaggtttgtctgagatggatatatgagcaaggtgctggtatattagtaaagagctacaatgaagtgcggatgaaggaaaacctggagatattcgattgggaattgagtgcagaagagttgaaaagtatcagtgaacttccacagcatagaggcttcccagctgattctctcctctcagctaaagggccatttagaactgaagaagagctctgggatggagagatctga

SEQ ID NO: 8 - DNA, 1020 bp, Corydalis chelantifolia
atggagagtgttgcttgtgagcctggagtaatcgagcagcagcagtactttattcccgaggtgacctgcggtggaggcagcagcaccaccaggatgaggatgcctgttgtaggcatgggtacagcctcgtacccgtttgctggatcagaaggtgtaaagcaagctctcttacatgcaatcaagcttggttactggcattttgatacagcttctttttaccagaccgagcaatctctgggtgaagctatctctgaggcaatccaacttgggctgatcaaatctagagatgaactcttcatcacttctaagctgtggtgcactgatgcacacaaagatcttgtcctccctgcccttcaaaacaccctcaggaatcttcaattggagtaccttgacctttaccttatacattttccgataagcttgaagccagggagatatgatttccctgtacaatcaaaggaggacctccttccaatggactttaaatctatatgggcaaaaatggaagagtgtcagggacttgggctcactaaatccattggtgtcagcaatttttcatgcaagaaacttgaaaatttacttgccacagccaagattcctcctgctgttaatcaggtagagatgaatccactttggcaacaaaagaaactaagggagttctgtaaagctaatggtatcactattacggcccactcccctttaggagccaaaggaactaattggggaaccaaccgtgtagtagaatgtgaagtgttgcaccagattgccaaggctaaaggaaaatctcatgctcaggtttgtttgagatgggtatatgagcaaggagtgagtctgttggtgaagagcttcaacaaagaaaggatgaaagagaacctggggatatttgactgggaattgaatgctgaagatttaaagaagatcagtgagattccacagggtagaggactacctgttgatggttttctttcaccaaatggtcctttcaagtctgaagaagaattttgggatggagagatttga

SEQ ID NO: 9 - DNA, 906 bp, Corydalis chelantifolia
atgcctgtagtaggctttggcacggctaaatttccctttggtgatgatgaagcgattaaattggcagttcttgaaggaatcaagcttggttacagacacttcgacactgctactaaatataaatcagagaagcctctcggtgaaaccattgttgaagctattaaccttggtttaatcaaatctcgtgatgaattattcatcacgtccaaattatggtgtggaagcactgagcgcagcctcatcgtaccttcactcaagacgagtttacagaatctccaattggactacctagatctttatctcatacattggcccctgaggtttagcaccgacgaaactccaacaccagtcccaaaggaacaacttcttccctttgacaccaagtcagtttggcaagcaatggaagaatgccaaaatctcgggctcacgaaatcgattggtgtgagtaatttctcatgcaaaaaacttgaagaattactatccactgcgaagatcactccggcagttaatcaagtggagttgaacacatcttggcaacagacgaagatgagagagttctgtaaaggaaaaggtatacatataactggttattcacctctaggttcctatggaacaaaatggggagacaacagagttgttgagaatcaagtgttggaggagattggcaagcctagaggaaaaactgctgttcaggtttgcttgagatggatatatgagcagggagcaagtatggttgtcaaaagctttaacaaagagaggatgaaggctaaccttgacatttttgattggaagttaactgaggaagagttgaagaggatcagtcagcttccacagcataaagcatccctacctactgcctcctttggcgaccatgatgaagttagggagcttgactatgagatctga

SEQ ID NO: 10 - DNA, 984 bp, Chelidonium majus
atggagagtgatagtgcagcagcagcagtagtagttccagtaacgactctgagctcaggcattgagatgccgatgttaggtatgggaactgttgaaaactttcttccaggttccgaaacagtgaagttggctcttctgaatgcaataaaattagggtacaggcacttcgacacagctgctatataccaaactgaggagtgtcttggtgaagctgtagctgaagcacttcaacttggtctgatcaaatctagagaccaactcttcatcacttccaagctttggtgttctgacgctcatcctgatcttgtcatccctgctcttcagaactctctcaggaagctgaagttggagtatcttgatttatatctggtacattggccgttaagctcaaagccagggaactgtgtttttccaatactcaaggaggacctccttcctttggacttcaagtctgtgtgggcagccatggaagaatgtcaaaagcttggcctcacaaagtcaattggtgttagcaacttctcttgtaagaagcttcaagatttattgacttcggctatcatccctcccgttgttaatcaagtggagatgaacccacgttggcaacaaaagaaactgagagagttttgtaaggccagagatattgtggttaccgcctactcgcctctgggagccaaaggcaccgtgtatggatccggtgcagttatggactgcgaggtgttgcaccagattgccaagattagagggaagtctgttgctcaggtttctctaagatgggtataccagcaaggtgtgacaccgttagtgaagagtttcaatgaagaaaggatgaaggagaacatgaagatattcgattgggaattgtacgaagaagacttaaaaatgatcgacgagatcccacaaagtagagtcaacccttgttattttttcctctcagaaaacggacccttcaagactgtagaagaattctgggatggagaagtctaa

SEQ ID NO: 11 - DNA, 984 bp, Chelidonium majus
atggagagtagtaataatgcagtattagttccagtaataactctgaactcaggcagggagatgccaattgttggtatgggaacagctgaaaacctttttcaaggttcagaaagagtgaagttggctcttttgactgcaataaaggtgggttatagacactttgatacagctgctgtttaccagactgaggagtctcttggtgaagctatagctgaagcacttcaacttggactgatcaaatctagagatgaactcttcatcacttccaagctgtggttgcctgattgtcaccatgatcttgtcctccctgctcttcagaattctctcaggaagcttaagttggagtaccttgacctatatttgatacattggccggtaagctcgaagccaggagagatcaagcatgttataccaaaggaagagctcctcccaatggatttcaagtctgtgtgggcagccatggaagaatgtcacaagcttggcctcgccaagtcaattggagtcagcaacttctcttgcaagaagcttcaagatttattagtcactgccaacatccctcctgatgttaaccaagtggagatgaacccactttggcagcagacgaaactgagggaattttgtaaggctcacggcatcctcgttgcagcttactcgcctttaggagccaaaggcactgcatggggaagaaccaacggagttatggactctgaggtgctacaacagattgccaaggctagaggaaagtctattgcgcaggtttctctacgatgggtatatgaacaaggggtggttttgttggtgaagagtttcaacgaggaaaggatgaaggaaaacctgaagatattcgattgggaattaagtggagaagacttgaaaaagatcagcgagatcctcccacagcgtagaggactccctagtcatgtttttgtctccgatgacgggccattcaagtctgaggaagaactctgggatggagaagtgtga

SEQ ID NO: 12 - DNA, 984 bp, Chelidonium majus
atggagagtagtaataatgcagtattagttccagtaataactctgaactcaggcagggagatgccaattgttggtatgggaacagctgaaaacctttttcaaggttcagaaagagtgaagttggctcttttgactgcaataaaggtgggttatagacactttgatacagctgctgtttaccagactgaggagtctcttggtgaagctatagctgaagcacttcaacttggactgatcaaatccagagatgaactcttcgtcacttccaagttgtggattcctgattgtcaccatgatcttgtcctccctgctcttcaaaattctctcaggaagcttaagttggagtaccttgacctctatttgatacattggccagtaagctctaagccaggggagctcaggtcacttataccaaaggaggagctccttccaatggatttcaagtctgtgtgggtggccatggaagaatgtcacaagcttggcctcacaaagtcaattggtgttagcaacttctcttgcaagaagcttcgagatttattgctcactgccaacatccctcctgctgttaaccaagtggagatgaacccgctttggcaacagaagaaactgagggagttttgtaaggccaacggtatcgtcattgcagcttactcgcctttaggagccaaaggcactgcatggggaagaaccaacgacggagttatggactctgagttgctacaaaagattgccaaggctagaggaaagtctacggcgcaggtttctctacgatggggatatgaacaaggggtgattttgttggtgaagagtttcaatgaagagaggatgaaggaaaacctgaagacattcgattgggaattaagtggagaagacttgaaacagatcaacgagatcctcccacagcgtagaggacatagccatgaatttatctcagataacgggccattcaagtctgaggaagagctatgggatggagaagtgtga

SEQ ID NO: 13 - DNA, 987 bp, Chelidonium majus
atgggtgaggaaatgatcaagacgagtagtgttgaaattccagtagcgactctaagcactgggaggacgatgccgttgttaggtatggggacagcagcatacccatttgtggggtcagatggagtggtgaaagcgattctgcacgcgattaagctagggtacaggcactttgatacagctgctctatactttacagaggaatgtcttggtgatgctgtagctgaagcacttcgccttggattgatcaaatctcgagatgaactcttcatcacctcaaagttatattgctgtgatgctcatcctgatcgcgtcgtccctgctcttcagaactctctcaggaagctgaaaatggagtaccttgatctatatttgatacattggccggcaagcacacacgaagggaacttcgaatttcctttacaaaagcaggatatccttcctttggatttcaagtctgtgtgggcagctatggaagaatgtcaaaagcttggcctcaccaagtcaattggtgtcagcaacttctcttgcaagaaacttcaagatttactagcctcggctaagatccctcccgctgttaatcaagtggagatgaacccaatttggcaacagaataaattgagggaattctgcaaggcaaatgatatccacattacagcgtactcgcctttgggggccaatggaactccttggggctctagtggagttgccgaaactcaagtgctgcacgacattgctaaggctagagggaagactcatgctcaggtttgtttgcgatgggtatatgagcaaggtgtgagtgtgttggttaagagttacaatgaagagaggatgaaggagaatctggctgtattggattgggaattgagcgaagagaacttgaagaagattagtgaaatcccacaacgtagaggacttcctggtgatatcttcgtctcagataacgggcctttcaaaactgtagaagagctctgggatggagaagtatga

SEQ ID NO: 14 - DNA, 921 bp, Cocculus trilobus
atgccagtggtggggatggggttggcagcctatccatttcaagaatcagaggtagtgaagttggcaatgctaagggccattgagatgggttacaggcatttcgacacggctgcgctgtaccagacagagcagtcacttggtctagccattgcagaagcgcttgagcttggcttgatcaagtcccgtgatgagctcttcatcacttccaagctctggtgcagtgatgctcatcctcaccttgtcattcctgctcttcaaaggactctcaagaatcttgggttggactatgttgatctctatctcatacactggccagtgagctcaaacaaaccaggaaagtatgattttccagtaccaaaggaagaactagttcaaatggattatgaatctgtatgggcagccatggaagagggacataggcttggcctcacaaagtccattggtgtaagcaacttttcttgtaagaagcttgagaatttactcacaatagcaaaggtccctcctactgtcaatcaagtggagatgaaccccttttggcgacaatataaactgaaagagttctgcaaggaaaagggaattattatcactgcttactcaccattgggagccaaaggaactatttggggcaccaacaaagttatggaatctaaagtgcttgaagacattggaattgctagtggaaagactcttgctcaggtctgtctgagatgggtgtatgagcaaggagtgactcttttggtaaaaagcttcaatgaggagaggatgaaggggaacctagacatatttgattgggaattaagtgagaaagagctgaaaaagatcaatgagattccacagagcagaggactccctggtgacatctttgtgtcagatgatggacccttcaagtctgaagcagagctctgggatggagaagtttga

SEQ ID NO: 15 - DNA, 966 bp, Eschscholzia californica
atggggagttgtagtataccagtgaagagtctgagctcaggaagggagatgcctgtaataggtatgggaactgctgacagcaatctagcaggctctgatgcttcaaggatagcactagtgaaagctatagaggttggttatagacactttgatacagcttcaatttaccagagtgagcaaaaccttggagatgccattgctcaagcacttgaacttggtctcatcaaatctagagatgaactattcattacttccaagctatggtcttcagattctcaccccgatcgtgtcgtccctgctcttcaagaatccctcaggaagcttaaattggagtatcttgatctatatctaatacattggccggcaagttcgacaccagggatttatgagttccctataccaaaagatgagatctttccattggagtatgagactatttgggcagccatggaagaatgtcagaggcttgggcttacaaaatctattggtgttagcaacttttcttccaagaagctccaaactatattgaacaccgccaccatccctccggctgccaatcaagtggagatgaacccagtttggcaacagaagaaattgaaagagttttgtgacgccaacaatatcctgcttactgcatattcgcctttgggtgctaaaggaacctcgtggggaagcaataaagttatggagtctgaggttctgaaacaaattgctatggcgaacgggaagtctgttgctcaggttagtctgagatggttataccaaataggtgcaactatggtagtgaaaagttacaatgcagaaaggatgaaggagaacctgaagatattcgattgggagttgagtgatgaagacatgaaagcaatcagcgagattcctcagcgtcgaaattttgctggtgatattctgatttcaagtaacgggcccttcaaatccgaagacgaactctgggatggagaagtatga

SEQ ID NO: 16 - DNA, 972 bp, Eschscholzia californica
atgagtagttatggtagtgtaccaatgaagtcactaaactcaggaagtaaaattcatgttttagggtttggaacagctgcttacccatttgtgggatcagatggtgtgaagaatgccattcttaatgctataaagttaggttataggcattttgacacagctgctctctacttcactgaggagtctcttggtgaagctgtttctgaagcacttcaacttggtctcatcaaatctagagatgaactcttcatcacttccaagctttggatttctgatgcttatcctgatcgtgtcctccccgccattcaaaaaacacttcggaaccttaaaatggagtaccttgatctatacctgatacactggcccattagtgggaaagaggggaattttgatcttcctgtacctaaagattgtctccaggaattggactacaagccagtgtgggcagccatggaagaatgtcaaaagcttggactcactaaatccattggtgttagcaatttctcttgtaagaaacttcaaatcattctctcctcagctaccatccctcctgctgttaatcaggtggagatgaacccaatttggcaccagaagaagttgagagaattttgtaaggccaataatatcatgattgctgcttattcgccgttaggagctgctgggaccccatggggatcctccggtgtcgtcgagaccgaagtgctacacgagatagccagaagtagaggcaaaactcatgctcaggtttgtttgagatgggtatatgagcaaggggtgattgtgttggtgaagagctttaatgaagagaggatgaaggaaaacctatctgtgtttgactgggagttgacggacgaagacttgaagaaaatcagtcaaattcctcaacgtagaggacttcctagtggtgatatttgggtctcgacagaaggacctttcagatctgaagaagagctttgggatggagaaatctaa

SEQ ID NO: 17 - DNA, 975 bp, Glaucium Flavum
atggagatgagtagtgcacaagtagttccactaatgactctaaactcaggcaaggagatacctgtattgggcatgggtactgctgaaaaccatttccaagggtctgatggaacaaaagatgcacttgttaatgcaataaaaattggttacagacactttgacacagctgctatatataacgttgaggagtgtcttggtgatgctatagctgaagcacttcaacatggtctcatcaaatcccgtgacgaacttttcatcacttcaaagctatggatatctgattcccaccctgaccgtgtcctctttgctcttcaaaattctctccggaagcttaagttggagtaccttgatctatatctgatacattggccgttaagctcaacgccagggaaatcggtgtttccggtacccaaggaggacttcctacctttggacttcaaatctgtgtgggcagccatggaagaatgccaaaaacttggcctcaccaagtcaattggtgtcagcaacttctcttgcaagaagctccaagatttattggacattgccaacatccctcctgcagttaatcaagtggagatgagcccactttggcaacagaagaaacttagggagttttgtaaggtcaatggtatacttgttacagcttactcgcctttaggagccaaaggcaccttctggggctctaatgaaattatggactctcatgtgttacaagagattgctaaggctagagggaagtctgttgctcaggttactctcagatgggtatatgagcaaggagtgattttgttggtgaagagttttaatgaaaatagaatgaaggagaatatggcgatatttgattgggatttgagcatcgacgacttgaaaaaattcgatgagatctcacagcgcagaggaaaccttggcgatttttttgtttcagaaaacgggcccttcaagtctgtagacatggtttgggatggagaggtctaa

SEQ ID NO: 18 - DNA, 981 bp, Glaucium Flavum
atggagagtagtagtagtagtgcagtagtagttccagtaatgactctgaactcaggcaaggagatgcctgtattaggtatgggaactgctgaaaacaatcttcaagggtctgagaaaacaaaattggctcttttgactgctataaaagccggttacagacactttgacacagcttctgcatacaatactgaggaggcactaggtgaggctgtggctgaagcacttcaacttggtctcattaaatctcgagacgaactcttcatcacttccaagctatggtgctctgatgctcaccctggacttgttgtccctgctcttcaaaattcactacggaatctaaagttggagtatcttgatctatatctgatacattggccagtaagtttaaagccgggaaaattcgtgattcctttttccaaggaggacatccttcctttggacttcaaaaatgtctgggcagctatggaagaatgtcaaaagcttggccttgccaagtcaattggtgtcagcaacttctcttgcaagaaactccaagacttattggcaattgccaacatccctcctgctgttaatcaagtggagatgagcccactttggcaacagaagaaactgagggagttttgtaaggtcaatggtatacttgttacagcttactcgcctttaggagccaaaggcaccttctggggctctaatgaaattatggactctgatgtgctaaaccaaattgctaaggctagaggaaagtctgttgctcaggtttctctcagatgggtacacgagcaaggggtgattttgttagtgaagagttttaatgaaaatagaatgaaggagaatatggccatatttgactgggaattgagcaacgacgacttgaaaaagatggatgagatctcacagcgtagaggaccccttgctgatatttttgtttcagaaaacgggcccttcaagtctgtagacatgctttgggatggagggttctga

SEQ ID NO: 19 - DNA, 981 bp, Glaucium Flavum
atggggagtagtgatgcagtagtagttccagtaaagactttgagctcggggaggaagatgcctgtaataggcatgggaactgctgaaatccttcttgtggacgggtccgaaaaagtgaagttggctcttctaaatgctattaaaattggttacagacactttgatacagctgctgtgtaccgaactgaagaggctttgggtgaggttgtggctgaagcaattcaacttggtctcatcaaatctagagacgaactattcatcacttcaaagttatggttatctgattctcaccctgatcttgttctccctgctcttcagaactctctaaggaagcttaagttcgagtatcttgacctatatttgatacattggccattaagctcaaagccaggggagctgaaggttcttataccgaaggaggaactccttcctttggacttcaaatctgtgtgggcagccatggaagaatgtcaaaaacttggtctgacaaagtcaattggagtcagcaacttctcttgcaagaagcttcaagatttattggacattgccaacatcccacccgcggttaaccaagtggagatgaacccactttggcaacagaaaaaattgaatgagttttgtaaagccaatgatatcgtcattacagcttactcgcctttgggagccaaaggcaccccttggggatccaatagagttatggactctgaggtattaaaccagattgccaaggctagaggaaagtctgttgcacaggttgctcttagatgggtatatgaacaaggtgtgagtctagtggtaaaaagttttaacgaagagcggatgaaggaaaacgtgacgaagatatttgattgggaattaagcgcagaagacttgaaaaagatcgaggaaatcccacaatgtagaggagtccctagccatgtttttgtctcagttaacgggcctttcaaatctgaagaagagctgtgggatggtgaaatctaa

SEQ ID NO: 20 - DNA, 984 bp, Glaucium Flavum
atgggtgaggaaatgaagatcaagagtgttgaaattccagtagtgacactaagctctggaaggaccatgcctgtgtttggtatgggtaccgcagcattcccatttgtagggtcagatggagtggtgaaagccattactcatgctataaagcttgggtataggcactttgatacggctgcactctacttcactgaggagtctcttggtgatgctatagctgaagcacttcgacttggactgatcaaatctcgagatgaactattcatcacttctaagctatggtgctgtgatgctcatcctgatcgtgtcctccctgctctgcgcaactctttgaggaatctgaaaatagagtatctagatctatacttgatacattggccggcaagcacacacgaagggaacttggaatttccaatacaaaagcaggacatccatcctttggattacaattctgtatgggcagccatggaggagtgtcaaacgcttggcctcaccaagtcaattggagtcagcaacttctcttgcaagaagcttcaacatatattagccattgccaagatccctcctgctgttaatcaagtggagatgaacccaatttggcaacagaagaaattaagagaattctgcaaggccaatgatatccatattacagcttactcgcctttaggagctaatgggaccccttgggggtctagtggagttgttgagactcaagtactacatgacattgctaaggctagagggaagactcatgctcaggtttgtctaagatgggtatacgagcaaggggtgattgtattggtgaagagctacaatgaagaaaggatgaaagagaatctgactgtattcgattgggaattgagcgcagaggactcgatgaagatcagtgagatcccacagcatagaggacttcctggtgatattttcgtttcagacagtgggcctttcaagtctgaagaggagctttgggatggagaagtctga

SEQ ID NO: 21 - DNA, 960 bp, Hydrastis canadensis
atgggtagtgttcctaatgtaattcttagctctggtcatccaatgcctcttgttggctttggcactgcgggttttccatttggaacatcagaaggtataaagtcagcaatactctgtgggatcaagaatggttacagacacttcgatacggcttccgtgtaccaaacagaacagatacttggtgaagctatagctgaagcacttgagctaggcctcattaaatctagagatgaactctttttaacctccaagctatggtgcagtgatgctcatcaacaacatgttctccctgcccttcagaagactctaaggactcttcagctggattatcttgatctttatctagtacactggccactgagctcaaaaccagggaagtatgagtacccaataccaaaggaagagcttcttcccatggatttcaaatctgtctgggctgcaatggaagagtgccaggctcttggcctcacaaagtccattggggtcagcaatttctcttgtaagaaacttgaacaattactctccacttcaaacatccctcctgctgtcaatcaagtggaggtcaacccaatttggcaacaaaataagctgagagagttttgtaaggccaaaggtataattgttgctgctttttctcctttgggtgctaaaggaacatcttggggaactaataaagttatggattctgaggtgctgaatgagattgcccaggctagaggaaagactactgctcagaattgtcttagatggttacatgagcaaggtgtgtgtgtggtggtgaagagcttcaatgaggagaggatgaaggggaacctgaaattatttgattgggaattgagtaaggaagagtctaagaagatcagccagttaccgcagagtaaaggacataccggagatgacatggtctcggccaatgggccatttaagtctttagaggagctatgggatggagagatttga

SEQ ID NO: 22 - DNA, 960 bp, Hydrastis canadensis
atgacaagaattccagagattgtgttgaactcaggatggaggatgccagttttggggatgggaacagcaacctttcctatccaatccccagaagtcattgagtcttccattgttaacgccatcgaattgggttatcgacacttcgacacagctagtgtatatcagtctgagtcacctctaggccgtgccatatcagaagctatacgtcgaggcctcattgagagtcgaaaagaggtcttcatcacctcgaagctatggtgcactgatgcacaccatgaccttgttatcccagctctccacaaaactctccagaatctggggttggagtacttggacttgtacctgattcatttcccagtgagactgaaaggagacatatcctttgacattaagaaggcagaccttataccctttgatgtaaagggtacatgggaggccatggagaagtgtcaagagctgggacttaccagatctattggtgttagcaacttttcatctaagaagctttccgagcttttaacccatgctaccatttctcccgctgtgaatcaggtggaaatgcacccattttggcaacagaaggaattgagagctttctgtgcagacaaaggtatacatgtaagtgcttattctcctttgggaggaaagggtgctttatggggctccgacatattactcaactccaaagagatcgaacggatcgctcaagctaaaggaaagagcatcgcgcaggtatgcttgagatgggcatatgaacaaggggtgagttacttaccaaaaagctacaataagggaaggatgaaagagaacatggaaatttttgactggcaattgagtgaagatgagttacaaaagatcagtcacctgccacaaggaaagatatacacaggacatcattttatatcagatgatggggaatataaatctcctattgatttatgggattgtgagatatgttag

SEQ ID NO: 23 - DNA, 963 bp, Hydrastis canadensis
atgggtatagttcgtgaggtagtgttgaattctggggaaagaatgccattgctaggaatgggaacagcaacatacccagttgctccatttgaactagttgagtcttcagtaattgctgccattgaacttggttataggcattttgacacagcaagtgtgtatgagacagagcaacctctaggcctagccatatctgaagccgtccggcaaggccttatcgctagtcgtgatgaaatcttcataaccactaagctttggtgtggtcatgcacattatgatcttgttctaccagctcttcgggactcactagaaacgatggggttggattatgttgatctgtacttgattcattttcctgcaagattcaacatgaaagagaagagcttaaatgtgaataagaaagatcttcttcctttggatataagagggacatggaaagctatggaggaatgttatgaacttggcttagcaaagtcaattggtgtcagcaacttcagttgcaaaaagctatctcaacttttgtctgttgctaacattccgcctgcagtgaatcaggtggagatgcatcctctttggcaacaacagaagttgagagagttttgtgaagaaaaaggtatacatgtgagtgcttattctcctttaggaggaaaagggaccatatggggctccaacgcagttttggactcagatcaaatcaaacaaatagctaaggctaaagggaagagtattgctcagatttgtttgagatggggatttgaacatggagtgagcattttaccaaagagcttcaacaaagaaaggttgaaagaaaatatggagatatttgattgggagctaagcaaggaagagttacaaaagatgaatacctttcctcaaaatagaatttttcaagctgagcatttagtctcacctgatgagggactgtttaaatctgttgctgatttgtgggatggtgaaatctaa

SEQ ID NO: 24 - DNA, 954 bp, Jeffersonia diphylla
atggggattgttcctgaggtgacattgaactctggccatcagatgcctcttgtaggctttggaacagcacagtttccttttccagagggggatgaagcaaaacaaattatagctccaatactatgtggaatcaagagtggttacagacacttcgacacagcttccctgtacaaaactgaggaagcacttggagaagctataaaagaggcacttcgtcttggccttatcaaatctcgagacgagctattcattacctcgaagctttggtgtactgattctcatcaagatcttgttcttcctgcccttaagaagactctccagaatcttcagatggactaccttgatctataccttgtacattttccagtaagctcaaagccgggaaagccagagttcccaccacagaaagaggaccttcttcctatggattttggatcggtatgggcagcaatggaagagtgccagaggctcggtctaaccaaatcaattggagtcagtaatttctcttgcaaaaagttagagcaactactcacaacagcaaagattattcccgcggttaacgaagtggagatgagcccagtttgccaacagaataagctgagagagttttgtaaggtaaaaaacattgttgtgactgcttactctcctctaggtggaggaagcaatgcagttaaggacaataaggtgctgaaagaaattgccaaggctaaaggaaaaacatgtgctcaggtcactctgagatgggtatacgagcaaggtgttgctctggtgcctaagagcttcaatgaggggaggatgaaggaaaacctggatatatttaattggacaataagtgaagaagagttcaaacagatcagccagttaccacagggtagagtggcaactggagaatggtttgtgtcggttgaagggccattcaagtctctagaggaactatgggatgaagtgatctga

SEQ ID NO: 25 - DNA, 966 bp, Mahonia aquifolium
atgggtgttgtacctgtggtaaccctgaactctggtcatgagatgccactagtaggctttggaacagcagtgcctgccttcgggggatcagacgccataaagcaagcaatactatgtggaatcaagaatggttacagacacttcgacactgcttctgtataccaaacagagaagtcgcttggagaagctatagtggaagcgcttcgccttggcctcatcaaatctcgagatgaactcttcattacctccaagttatggtgtacagatgctcatcaagatggcgttctccctgcccttagggagactctcaagaatcttcagttggattaccttgatctttaccttatacattggccgctaagcgcaaagccagggaagcatgagtaccaaataccaaaggatgagcttcttcctatggactatgaatccgtatggggagcaatggaagaatgccagaggcttgacctctctaagtccattggagtcagcaacttctctatcaagaagcttgaagagctactcaaaactgcaaagattattcctgcagttaatgaagtggaagtgaaccctgtttggcatcaaaataagctaatagagttctgtaaggccaaaggtattgttgtgactggttactctcctttaggtgccaaaggaacaacttggggaaccaatagagtcatggacaatgaggtcctgaaagagattgctaagactagaggaaagacccatgctcaggtttgtctgagatggatatacgagcaaggagttggcctggtggcgaagagctttaatgaagagaggatgaaggagaatttagagatatttgattgggcattgactgaagaagagtctaaacagatcagccagttaccacaatataaagggcaaaatggagaaacgtttctctcagctgaagggcctttcaagaccttagaggagctatgggatgaagagatagcagcttga

SEQ ID NO: 26 - DNA, 963 bp, Menispermum canadense
atggcgagtgttccagaggtgacactgagctctggccatccaatgcctctctttggcttcggcaccgcagcctggccttttgtgtcttcagaaggagctaagtctgcaatattgtgtgggatggagctcggttacagacacttcgacactgcttccatttacggcacagagagctctctcggcgaagccatagccgaagctcttaagctcggcatcatcaagtctcgcgacgagctcttcatcacctctaagctctggtgctgcgacgggcaccatgaccgagtcttgcctgcccttcaaatgactctaaagaatcttcaattggactacattgatctgtatctcgaacactggccattgagctcagtccctaaaggtgagcttgagtacccaataccaaaagaaaaactgtttcctatggatttgaaggctgtgtgggaagccatggaagagtgccagaggcttggcctcaccaagtccattggagtcagcaacttctcttgcaagaagcttgaagatttactcgccttcgcgaagatccctccggccgtcaatgaagtggagatgaacccagtttggcaacagaagaaactgagggacttctgtaaggctaaaggtattgttttgacggcttactcagtgttaggagccaaaggaaccctttggggcactaacaaagttatggactctgaggtgctaggaaagattgccaaggcaagaggcaagactgttggtcaggtttgtttgagatgggcatatgagcaaggtgcgtgtgtgttggtgaagagcttcaatgaggaaagaatgaaagagaacttagagacatttaactgggagttaggagaggaagacttgaagatgattagtgaaataccacaatataaaggacttcgtggtgaggatatggtggctcctaatgggccttacaagactttagaggaactttgggatggagagatatga

SEQ ID NO: 27 - DNA, 1026 bp, Menispermum canadense
atgggagttgataagacaaacgagttctctaatggcaacgcagcgagcccagtactgatcaaagaggctaacctctttaagattgccgaggtgacgttgaactccggtcaccatatgccggttctgggaactgggacggcttcgtttccgtttcctccgttgaaggagctgaagaaggcgatcgtggaagccatggaagtgggctatcgccacttcgactcggccgcgctgtaccagagcgaggaagggctcggtgcagccatagctgaggctttggagaagggacttgtgaagaagagagaagaactattcatcaccaccaagctatggtgcaataatgcccactctgatcgtgtcctgcccgccattcgtgaatctctcaggaaactaagactagactatgtagatttgtatttgattcatttcccagtaaggctgaaggaagatttattggatatgaattgtaagaagggtgggatttttgaacttgacctcaaatcagtatgggcagcaatggagcagatacaacacctaggtcttgcaaagtcaattggagtcagcaacttcacttgtaagaagcttactgaccttctttcttatgcaaagatccctcctgcagttaatcaggtagaaatgcatccagtgtggcaacaaaagaagcttagagacttctgcaaggagaaaggcatccatgttagtgcatattctcctctaggagcaaagcaatggggatttgatgttgttctcggtaacaaaatcttgaaagagattgcacaagacaaaggaaagacaattgctcagattgctttaagatggggatatgagcaaggagtgattttgatcccaaagagctttaacaagggaaggttgactgaaaatcttcgcatatttgactggaagctaactgaagatgaattaaagaagatttcatcaattcaacagagccgagtagctataatgcctgaatttgtgtttcctgaaagtccattcaagacctttgaagatttctgggatggggaaatgtga

SEQ ID NO: 28 - DNA, 969 bp, Menispermum canadense
atggaaggaggaggagttcctaagatactcttgaattcagggcataggatgcctgtgcttggaatgggcacagcttccttcccaatctcaccacaacacctcgtcaagtcttccatactaaccgctatcgaacttggctacacccacttcgacaccgcaagcgtctatgagactgagcctacactcagccgggctatccgccaagccctcgagggtagacacattgcgagccgagaccagctcttcatcaccaccaagctctggtgcggccaagcacaaagcgatctcgtcgtcccagctcttcgcgaatcacttcaggaacttgggttggactatgttgatctgtacttgattcattttccagctagatttaagtgtgtggagaagacatttaatgtcaccaaagaggatcttcttcctttggacatgaaggggacatggcaggccatggaggagtgttgtaaacttggcctggccaagtccattggtgtcagcaacttcagctgcaagaagctctctcagattctcacctttgccaccatccctcctgcagtcaatcaggtggaaatgcacccattatggcagcaaaggaaactgagagagttctgtaaggagaaaggcatccatgtgagtgcctactctcctttaggtgggaaaggtgccaagtggggttccaatgcagtgtttgaatgtgaagaaatcaaacagattgctgaagctaaagggaagagtttggctcagatttgtctgaggtgggcttttgagcaaggtgtgagttttgtgccaaagagctttaacaaggaaaggttgaaagagaacatggagatatatggttgggagctgagcaaggaggaattgcaaaagttaagtgttctgccacagtgcaggatcttcaaaggagaatggctagtgtcagctgatcatggagtgttcaaatcagttgaagatttgtgggatggagaaatataa

SEQ ID NO: 29 - DNA, 960 bp, Nandina domestica
atggtgagtgttccagaggtaaccctgaactccggtcaccggatgcctcttgtgggtatgggcacggcatgctttcctcttccaggatcagaagtggtgaagtcggcgatggtaacggcaatcaagcttggttatcgccacttcgataccgctgcgctttaccagagcgagcagcctctaggtgaagctatagctgaagcacttcaccttggcctcataatatctagggatgaactttttatcacctccaagctatggtgtactgatgctcaccaagatcttgttctccctgctcttaagacaagtctccgaaatcttcagttggattaccttgatctttaccttatacattttccggtgagtttgaagccagggaagatacagctgccggtaccaaaggaagagcttcttccaatggatttcaagtctgtgtgggcagccatggaggaatgtcagaagcttggcctcacaaagtccattggagtaagcaatttctcttgcaagaaactcgaacacatactttcattggcaaagattcctcctgcagttaatcaagtggagctgaacccaatttggcgacaaaaaaagctcatcgagttttgtaaggccaaaggtattgttgttacggcatattctcctttgggagctgtagcacccggtcaaggcagcaatagagtcatggaatgtgaagtgctgagcgagattgcaaaagctcgaggaaaaactcatgcgcaggtttgtcttagatggataattgagcaaggggtcagtttagttgtgaaaagcttcaatgaggacaggaagaagaagaacttggagatattcgactgggaattgagcgaagaagattccaaaaaaatcagccagataccagagactagaggaaaccccggagattttgtcatctctgttgatggtccttataagtctagagaggagctttgggatggagaaatctga

SEQ ID NO: 30 - DNA, 960 bp, Nandina domestica
atgggaagagttcctgagactaccttgagttctgggcataacatgccattgttggggatgggaacagcaaccttccctctccctccatctgaattgatagaatcttatattcttgctgccattgaaatggggtatagacactttgacactgctagtgtttacgacacagaagtaccccttggtcgagccatatctgaagccctccggagaggtcttgtggcaaatcgtgatgaactcttcattaccaccaaactctggtgtggtcatgcacatccagatctcgttgttccagctcttcaccaatctctcatggaaatgggattggaatatgtggatttgtatttgattcattttccagctaggtttaacaaaaaggaaaagaactttgatgtgaagaaagaggaagtcattcccttggacatgaagggaacatgggaagccatggaagagtgtagcaaacttggacttgcaaagtccattggtgtaagcaacttcagctgcaaaaagctctctcaactcctcacctatgccactatccctcctgcagtgaatcaggtagaaatgcaccctctttggcaacaatggaaattgagagaattttgcgtagcaaatgatatacatgtgactgcctattctcctctaggggggaaaggagcattgtggggttcgaattcagtgctcgattcaaaagaaatccaacaaatggctgaagcaaaaggaaagagtatcgctcagatatgtttgagatgggcatttgaacaaggagtaagcttcataccgaaaagcttcaatgtcgaaaggctaaaagaaaatatggaaatatttgattgggaaatgaacaagaatgagttgttgaaaatgagtttgcttccacaaaaaaggactttcactgcagaatatttggtatcacctgatggggcgtttaaatcggttgacgatttatgggatggggagatataa

SEQ ID NO: 31 - DNA, 960 bp, Nigella sativa
atggcaagagtacctgagataaccttaaactccggccaccggatgcctctcttgggtatgggaactgcagtagttccctttaaagaaccagaaccagtgaagtcagcaatactcactgcaatcaagaatggttacaggcacttcgatacagcttctctgtaccgaactgagccagcccttggagatgctatagctgaagcacttcaacttggcctcatcaactccagggacgaccttttcatcacctccaagctctggtgcactgacaaccaccctgatctggtcctccctgcactgcacacaacacttcgaaatctgaagttggactaccttgatctatatctaatacattggccagtaagcatgactccagggagaattcggttccctgggccggatgagaagatacttccaatggattacaagtctgtatgggcagccatggaagagtgtcaaaagcttggcctcacaaaatcaattggagtcagcaattttacctgcaagaagcttgaattgttactggcatcagctactatccctcctgctgttaatcaagtggaggtgaaccctatgtggcaacaggaaaagctgatagagttttgtaggactaaaggtattgttgtaacagcttacgctcccttggggactgttggaacatttataggtaacaacgatattatgaactgtgagttactgaaagaaattgcccaagctaaaggaaagacaaatggtcagatttgtctcagatgggtacatgaacaaggagtgggtctgctagtaaagagcttcactgaggtgagaatgaaacagaatcttgagatatttgattgggaactaagtgaagaagaatcaatgaaaattaaacaactgccacaaagaaagagtcatcaagggaagggctttgttactgctgatggaccattcaaatcgttgacagagctttgggatggagagatgtga

SEQ ID NO: 32 - DNA, 954 bp, Nigella sativa
atggtttatgagatcatgttgaactctggatacagaattccattgctgggaatgggaacagcagcctatccagtgcctccaccagagctagtggagtcttctgttcttgctgcaattgaactcggttataggcactttgacactgcccatatttatggaacggaagcacctttgggaagagccatatcagaagccttgaggaagggattgatcaaaagtcgagatgaactcttcataactactaagctctggcctggccatgcacgccctgatcttgttctacaagctttgcatcaatctttagaagctttgaggattgattacgttgatctgttcctaattcattttccagcacggtacaacacaacagaaataagaatggatataaagaaggaagacatccttcctttggatatcaagggaacatggcaggccatggaagagtgttgtaaacttggcttggccaagtccatcggtgtcagcaacttcggttgcaagaagctatcccaactattggattcagccactatcccacctgcagttaatcaggtggaaatgcatcctctctggcaacaagcaaaactgagagagttttgtgcagaaaggggtatccatgtcagtgcctattctcctttaggaggaaaggggactctctggggatccaatgcagtgcttgattctgagcaaatcaaacagattgcacttgctaaggggaagagtgtagcgcagatatgcttgagatggggttttcaacaaggagtaagcatcatagcaaagagcttcaacagagaaagactcaaagaaaatatggaaatatttgattgggaattgaacaaggaagaactatacaagctaagcatccttcctcaaaataggatttcaacccttgaatatttagtgtcaccggatgcagttttcaaatcaattaacgatttgtgggatgaagaagtttga

SEQ ID NO: 33 - DNA, 957 bp, Nigella sativa
atggataacagtgtagtagtgctgaattctggacatagaatgccattgttagggatgggaacagcagccactcctttacctcccaatgaagttgtccagtcttcagttcttgctgcaatcgaactgggttacaggcattttgatacagcaagtgtgtatggctcagaagtgattttaggtagagccatatctgaagctttaaggagaggtttggttgctagtagagatgagcttttcataactactaagctttggtgtggtaatggacaccctgatcttgttcttggtgctcttcaagaatctttaagaattatggagctggattatgtggacttgtacttgattcattttcctgtgagattcaatataacagagaagctcttaaatatgaagaatgttcctcttcttccttttgacatggaagggacatggcaagctatggaggagtgttgtagactgggtttagccaagtccattggtgttagcaattttagttgcaaaaggctatctgaacttctactttccgcttccatccctcctgctgtgaatcaggtggaaatgcatccgctttggcagcaaagaaatatgagagagttttgtagaaaagaaggaattcatgtgagtgcttattctcctttaggaggaaaaggagcagcttgggggtcgaatgcagtgctagattctgaagatatccaacaaatagctcaacataaagaaaagagtgttgctcaggtatgcttgagatgggcgtttgagcaaggagtgagcattatagtaaagagtttcaataaagaaaggcttaaagaaaatacacaaattttcgactgggagctcaacaaacaagagttgcagagaatcaatactcttccacaaaataagatttttaaagcttcaaatttgatttcagcagatggaccatataaaacatttgaggaattgtgggatggagaggtatga

SEQ ID NO: 34 - DNA, 960 bp, Papaver Bracteatum
atggagagtaatggtgtacctatgatcactctcagttccggcattcggatgcctgctttaggtatgggaacagttgaaacaatggaaaagggaacagaaagagagaaattggcgtttttgaaagcgatagaggtcggttacagacacttcgatgcagctgctgcatatcaaactgaagagtgtcttggtgaagctatagctgaagcacttcaacttggtctaattaaatctcgagatgaactcttcatcacttccaagctctggtgcactgatgctcacgctgatctcgtcctccctgctcttcagaattctctgaggaatcttaaattggagtatctggatctatatttgatacactttccgctaagcttgaaaccagggaagattgttaacgaaataccaaaggatcaaatgcttccaatggactacaaatctgtgtgggcagccatggaagagtgtcagacccttggcttcactagggcaatcggtgtcagcaatttctcatgcaaaaagcttcaagagttgatggcgacagccaacagccctccagttgtaaatgaagtggagatgagcccgattttccaacaaaaaaaattgagagcatattgcaaggccaataatatcatgatcactgcatactcggttttgggatccagaggagccgcatggggcagcaatgcagttatggattctaaggtgcttcacgagattgctgtgtccagaggaaaatctgttgctcaggttagtatgagatgggtttaccagcaaggcgcgtgtcttgtggtgaaaagtttcaatgaagagagaatgaaggaaaaccttaagatattcgattgggagctatcggcagaagacatggaaaagatcagtgagattccgcaatgtagaacaagctctgttgatttcttgttatcaccgactgggcctttcaaaactgaagaagagttctgggatgagtag

SEQ ID NO: 35 - DNA, 966 bp, Papaver Bracteatum
atggagattaatggtgtaccagtgatcagtctaagctcgggcgttcggatgcctgctttaggtatgggaacagctgaaacaatggaaaaaggaaccgacagagagagatcagcgtttttgaaagcgattgaggtcggttacaggcacttcgatacagctgctgcttatcaaactgaagagtgtcttggtgaagctatagctgaagcacttcaacttggtctaattaaatctcgagatgaactcttcatcacttccaagctctggtgcactgatgctcacgctgatctcgtcctccctgctcttcagaattctctgaggaatctcaaattggagtatcttgatctatatttgatacacgctccggtaagcttgaagccagggaagattcttaacgaaataccaaaggatcaaatgcttccaatggactacaaatctgtgtgggcagccatggaagagtgtcagacccttggcttcactagggcaatcggtgtcagcaatttctcatgcaaaaagcttcaagagttgatggcgacagctaatagccctccagtggtaaatgaagtggagatgagccccactttacatcaaaaaaatctgagagaatattgcaaggccaataatatcatgatcattgcatactcggttttgggagccagaggaaccggatggggcagcaacgcagttatggattctaaggtgcttcaccagattgctgtggccagaggaaaatctgttgctcaggttagcatgagatgggtttaccagcaaggtgcgtgtcttgtggtaaaaagtttcaatgaagagaggatgaaggaaaaccttaaaatattcgattgggaactaacggaagaagacatggataagatcagtgagattccgcaatccagaacactatctgctgatttcttgttatcaccgactggacctttcaaaactgaagaagagttctgggatgaaatggtttga

SEQ ID NO: 36 - DNA, 972 bp, Papaver Bracteatum
atgaggaatactggtgtacctgtaatcactctgagctcggggaaggggatacctgttttaggtatgggaacatttgaaacagttggtaaagggggtgaacgagagaggttggcgtttttgaaagcgatagaggtgggttacagacacttcgatactgctgcgtgctaccaaactgaagagtgtcttggtgaagctatagaggaagcacttcaacttggcctaatcaaatctcgagatgaactctttatcacttctaagctctggtgcaccgacgctcaccctgaccgtgtcctgttggctcttcagaattctctgaggaatcttaagttggagtatctggatctatacctgatacactttccagtaagcttgaagccagggaatgaggttactatggatgcagcagggggcgaaatttttctaatggactacaagtctgtatgggcagccatggaagagtgtcagaaccttggcttcactaagtcaatcggtgtcagcaatttctcctgcaaaaagcttcaggaattattggcgacagcaaacatccctccagttgtaaatcaagtggagatgagcccagttttccaccaaaagaatctgagagagtattgcaaggccaataatatactggtggctgcatactcgattttgggaggcaagggaaccgcatggggctccaattcagttttgggttccgaggggcttaaccagattgctatcgccagaggaaagtctattgctcaggttagcatgagatgggtatacgagcaaggcgcgattcttgtggtgaaaagtttcagtgaaaagaatatgagggaaaacttgaacatattcgattgggaactgactaaggaagacctggaaaggattggtgagattcctcagcgcagattaataattcaggaatttatggtatcatctaatggacctttcaaatctctagaagagttctgggatgaaaaagctgattga

SEQ ID NO: 37 - DNA, 966 bp, Papaver Bracteatum
atggagaatgtaatacctgcagtgacattaagttctggaagtgtgatgcctatattaggtatgggcactgctgcatacccattagttgaaccagaagaagcgaaattggcgtttttgaatgctatcaagattggttacagacattttgatacagctgcttcttaccattgtgaaggatttcttggtgaagctatagctgaagcacttcaacttggtttgataaaatctcgagacgaactgtttatcacttctaagctctggccctgtgatgctcaccctgaccttgtcatccccgcaattcagaactctctaaggaatctaaagttggagtaccttgatctatatctgatacattttccaataagcacgaaaccagctgcagggcttgtttttccgccaccaaaggatgctttgcttccaatggattacaagtctgtatgggcagctatggaagagtgtcaaaaacttggtcttacaaagtcaattggtgtcagcaacttctcttgtaagaagcttcaaaccattttggacattgctaacatccctccagctgttaaccaagtggagatgaacccagtttggcagaacttgaaattgagggacttctgcaaggctaacaatatcgttctcactgcctactcacctttaggagccaggggaaccccgtgggggtctaatgcagtctatgaggagcgagttctgcatgaaattgctgaggctaaagggaaaactcatgcacaggtgtgtctaagatgggtatacgagcaaggagtgagtcttatagtcaagagcttcaatgagttgaggatgaaggagaatatgatgattttcgactgggaactgactgaagatgaactgcaaaagataggcaaaatcccacagaggagaggactcccaggtgatttttttgtctcggaagcagcgcctttcaagactgtcgaagaattttgggacggagaaatttga

SEQ ID NO: 38 - DNA, 969 bp, Papaver Bracteatum
atggaggttgtaatccctaaagtggcactgagttctggtagagtgatgcctgtgctaggaatgggcacatcatcattcccgccagttggtccggaagatggaaaagccgccattttgaatgctatcaagattggttatagacactttgatacagcttctgtttacaagtctgaagacttcctcggtgaagctatagctgaagcacttctacttggattgatccaatctcgagaccagcttttcattacttccaagttatattgcaatgatgctcaccctgatcttgttgtccctgctttacagaactctctcaggaatctgaggctggagtaccttgatctatatctgatacactttccggtaagctcaaagccagtcaagtacgagtatcatctaaaaaaggagcatctcctccctatggactacgaatctgtgtgggcagccatggaaaagtgtcaaaagcttggacttacaaagtcaattggagtcagcaatttctcttgcaagaagcttcaaactattttggacactgctaacatctctcctgctgttaatcaagtggagatgaatccagtttggcaaaacttgaaactgagggatttctgcaaagctaaaggtatcgttgtcactgcctactcacctttgggagccagcggaaccccctggggatctaatgcagtcaaagaagcacaggaattgcacgaaatcgcaaaagctagagggaaaactcatgctcaggtttgtcttagatgggtatacgagcaaggagtgagcttgctagtcaagagcttcaaagaagaacggatgaaagagaacctaatgatctttgattgggagttgactaaagatgatttgttcaaaatcagcaaaattacacaacgcagaggactaccaggttataggttcatctcgaaacttgaagggtcacccttcaagacggtcgaagaattctgggatggagaagtttaa

SEQ ID NO: 39 - DNA, 966 bp, Papaver Bracteatum
atggagagtagtggtgtaccagtaatcactctgagatcgggcaaggtgatgcctgttttaggcatgggaacatttgagaaagctggtaaagggtctgaaagagagaggttggcgatattaaaagcgatagaggtgggttacagatacttcgacacagctgctgcatacgaaactgaagaggttcttggagaagctattgctgaagcacttcaacttggcctaatcaaatctcgagatgaacttttcatcagttccatgctctggtgcactgatgctcaccctgatcgtgtcctcctcgctcttcagaattctctgaggaatcttaaattggagtatgtggatctatatatgttacccttcccggcaagcttgaagccagggaagataacgatggacataccagaggaagatatttgtccaatggactacaggtctgtatggtcagccatggaagagtgtcaaaaccttggcctcactaaatcaatcggtgttagcaatttctcctgcaaaaaacttgaggaattgatggcgaccgccaacatccctccagccgtgaatcaagtggagatgagcccggctttccaacaaaagaagctgagagagtattgcaacgcaaataatatattagtcagcgcagtctctatactgggatcaaacggaaccccatggggctccaatgcagttttgggttctgaggtgcttaagaaaattgctatggccaaaggaaaatctgttgctcaggttagtatgagatgggtttacgagcaaggcgcgagtcttgtggtaaaaagtttcagtgaagagagattgagggaaaacttgaacatattcgactggcaactcaccaaggaagacaatgaaaagatcggtgagattccacagtgcagaatcttgagtgcttattttttggtctcacctaaagggcctttcaaatctcaagaagagttgtgggatgacaaagcttga

SEQ ID NO: 40 - DNA, 972 bp, Papaver Bracteatum
atgggaagtagttgtattcctgttctcactttgaactcgggcaataagatgcctgttttaggtatgggaacatttgaaacatttgctaaagggggtgaaagagaaagattggcgtatttgaaagcgattaaagtgggttacagatacttcgatacaggcgctgcatacggaacggaagaggttcttggccaagctatagctgaagcacttcaacttggcctaataaaatctcgagatgaactcttcatcagtaccatgatctgggccactgatgctcaccctgatggtgtcctccccgctgttcagagatctttaaggaatcttaaattggactatgtggatctctacctgataccatttccggcaagcttgaacccagaaggggagatacctaattacataccagagaacgaaacttttttaaaaatggactacaagtctgtatgggcagctatggaagagtgtcaaacccttggctttaccaagtctatcggtgtcagcaatttctcctgcaaaaagcttcaggaagtgatggagaccgcaaatatccctccggctgtcaacatggtggaaatgaaccctactttccaacaaaaatatctgagagagtactgcaaggccaataatatattagtcaatgcgtactctgttttgggatccacgggaacttcatggggctccaatgcagttatgggttctgaggtgcttaagcaaattgctacggacataggaaaatctattgctcaggttagtatgagatgggtttacgagcaaggtgcgggttttgtggtaaaaagtttcagtgaagagaggatgagggaaaacttgaacatattcgactgggagctgactaaggaagacttggagaagatcagtcagattccacaatgcagagtactacctatggattttttggtatcatctgatggagctttcaaatctttggaagacttgtgggatggtgaagcttga

SEQ ID NO: 41 - DNA, 912 bp, Papaver Bracteatum
atgccgatcttaggttttggaacagctgaaaacctttttgaagggggtgataaagtgaagttggcgattttgaaagcgatagaggtgggttacagatacattgatacagctgccgtgtaccgaactgaagagtctgttggtgaagctgtagcagaagcacttcaacttggcttgataaaatctcgagacgagctattcataacctccaagctatggggtgtcgatgctcatcctgatcttgtcctcccagctcttcagaactcattgaggaaacttaaattggagtatttggatctgtatctgatacactatccggtaagcttgaagccaggggagatggtcgatgatataccgaaggacgaaatatttccactggactacaagtctgtatgggcagccatggaagagtgtcagaagcttggctacactaagtcaatcggggtcagtaatttctcttgcaaaaagcttcaacagcttatggccacagctaacatacctccagctgtaaatcaagtggagatgaacccaacttggcaacaaaagaatctaagggaatactgtaaggccaacaatatcttcattacagcatactcgactttgggagctaaagaccttttatggggctccaatgcagttttaggctctaaagtgttgaaccagattgccgtggccagaggaaaatcagttgcccaggttagtctgagatgggtttacgaacaaggtgtgagtcttgtggtgaaaagttttaacgaggagaggatgaaggagaacttgaagatatttgattgggaactgaccacagaagacttgaaaatgatcagtgagatccctcaacgcagagtagcaactgcggatttttttgtgtcagatattggacccttcaaatctttagaagagctgtgggatgaataa

SEQ ID NO: 42 - DNA, 921 bp, Papaver Bracteatum
atgccggttttaggactgggaacagctgaaaaccttactaaaggttctgaaagagagatgctggcgattttgaaggcgatagaggtgggttacagacactttgatacagctttcatataccaaactcaagagtgtgttggtgaagctatagctgaagcacttcaactaggtatcatcaaatctcgggatgaactctttatcacttccaagctctggggttctgatgctcaccctgattgcgtcctcctggctcttcagaattctctaaggaatcttaaactgcagtatctggatctatatctgatacactatccagtaagcttgaagccagggacaactttgaaagatttggggaataaggacaacttccttccaatggactacaagtctgtatgggcagctatggaagagtgtcagaagcttggcctcactaagtcgataggtgtcagcaacttctcctccaaaaagattcaagagctaatgagcacagacagcatccctcctgccgtaaatcaagtagagatgaaccccacatggcaacaaaagaaactgagagaatattgtcaggccaacaatatcttagttactgcatactctcctttgggagctaaaggaaccacatggggatccaatgcggttatgggatctgaggtactgaaccagattgcccttgccagagggaaatctgttgctcagattagtctaagatgggtttacgagcaaggtgtgagtctcgtggtgaaaagcttcaatgaagagaggatgagggagaacctgaaaatatttgactgggagctaactgccgaagacttgaaaaagatagatgagcttccacagagcagagtggcaactgctgaatttgttgtatcagagaatgggcccttcaagtctttagaagaattttgggatgacgagtcctga

SEQ ID NO: 43 - DNA, 966 bp, Papaver Bracteatum
atggagaatgcaatacccgcggtaacattgaattctggaagtgtgatgcctgtattaggtatgggaactgctgcatacccatttgtcgaatcagaagaagcgaaattggcgattttgaatgctatcaagactggttacagacatttagatactgctgctctttaccagtctgaagaatcacttggtgaagctgtatctgaagcaattcaacttggtttgataaaatctcgagacgaactgtttatcacttctaagctctggccctgtgatgctcaccctgaccttgtcatccccgcaattcagaactctctaaggaatctaaagttggagtaccttgatctatatctgatacattttccaataagcacgaaaccagctgcagggcttgtttttccgccaccaaaggatgctttgcttccaatggattacaagtctgtatgggcagctatggaagagtgtcaaaaacttggtcttacaaagtcaattggtgtcagcaacttctcttgtaagaagcttcaaaccattttggacattgctaacatccctccagctgttaaccaagtggagatgaacccagtttggcagaacttgcaattgagggacttctgcaaggataagagtatcattctcactgcctactcaccattagaagggaagggaaccccgtgggggtctaatgcagtctacggagcacaagttttgcatgaaattgctgaggctaaaggcaaaactcacgcacaggtttgtctgagatgggtatatgagcaaggagtgagtctgctagtgaagagcttcaatgatcagaggatgaaggaaaacatgatgattttcgattgggaactgaccgaggatgaactggaaaagataagcagaatcccacagaggagaggactcccaggtgatttttttgtctcggaagcagcgcctttcaagactgtcgaagaattttgggacggagaaatttga

SEQ ID NO: 44 - DNA, 966 bp, Papaver Bracteatum
atggagaatgcaatacccgcggtaacattgaattctggaagtgtgatgcctgtattaggtatgggaactgctgcatacccatttgtcgaatcagaagaagcgaaattggcgattttgaatgctatcaagactggttacagacatttagatactgctgctctttaccagtctgaagaatcacttggtgaagctgtagctgaagcaattcaacttggtttaataaaatctcgagacgaactttttatcacttctaagctatggccttgtgatgcacaccctgaccgtgtcgtccctactcttcagaactctctaaggaagttaaagttggagtaccttgatctatatctaatacattggccagtaagctcgaacccagtggcagggcatgtgttatcgctgccaaaggattctttggttacaatggattacgagtctgtatgggcagctatggaagagtgtcaaaaacttggtcttacaaagtcaattggtgtcagcaacttctcttgtaagaagcttcaaaccattttggacattgctaacatccctccagctgttaaccaagtggagatgaacccagtttggcagaacttgaaattgagggacttctgcaaggctaacaatatcgttctcactgcctactcacctttaggagccaggggaaccccgtgggggtctaatgcagtctatgaggagcgagttctgcatgaaattgctgaggctaaagggaaaactcatgcacaggtgtgtctaagatgggtatacgagcaaggagtgagtcttatagtcaagagcttcaatgagttgaggatgaaggagaatatgatgattttcgactgggaactgactgaagatgaactgcaaaagataggcaaaatcccacagaggagaggactcccaggtgatttttttgtctcggaagcagcgcctttcaagactgtcgaagaattttgggacggagaaatttga

SEQ ID NO: 45 - DNA, 972 bp, Papaver Bracteatum
atggagaatgtaatacctgcagtgacattaagttctggaagtgtgatgcctatattggctatgggcactgctgcatacccattagttgaaccagaagaagcgaaattggcgtttttgaatgctatcaagattggttacagacattttgatacagctgcttcttaccattgtgaaggatttcttggtgaagctatagctgaagcacttcaacttggtttgataaaatctcgagacgaactgtttatcacttctaagctctggccctgtgatgctcaccctgaccttgtcatccccgcaattcagaactctctaaggaatctaaagttggagtaccttgatctatatctgatacattttccaataagcacgaaaccagctgcagggcttgtttttccgccaccaaaggatgctttgcttccaatggattacaagtctgtatgggcagctatggaagagtgtcaaaaacttggtcttacaaagtcaattggtgtcagcaacttctcttgtaagaagcttcaaaccattttggacattgctaacatccctccagctgttaaccaagtggagatgaacccagtttggcagaacttgcaattgagggacttctgcaaggataagagtatcattctcactgcctactcaccattagaagggaagggaaccccgtgggggtctaatgcagtctacggagcacaagttttgcatgaaattgctgaggctaaaggcaaaactcacgcacaggtttgtctgagatgggtatatgagcaaggagtgagtctgctagtgaagagcttcaatgatcagaggatgaaagaaaacatgatgattttcgattgggaactcactgaagatgaactggaaaagataggcaaaatcccacagagtagaggactcccaggtgatgtttttgtctcggaacttgaagctgcccctttcaagactgtcgaagaattctgggacggagaggtttga

SEQ ID NO: 46 - DNA, 960 bp, Sanguinaria canadensis
atggagaacgtctctgtagtgactttgaactcaggaagagagatgccaattctaggtatgggcaccgctgcatacccttctgttggctcagaagaagccaaattggcgattcttcttgcgataaaggtcggctacagacactttgacacagctgctgcttaccagattgagtcttctcttggcgaagctgtagctgaagcacttcaacttggactgctcaaatctcgagatgaactcttcatcacctccaagttatggtgctctgattctcaccctgaacgtgtcctccccgctcttcagaactccctccggaatcttaagttggagtatcttgatctatatctgatacattggccggtaagcttgaagccagggaactttgatctgactatacccaaagaggatttgctccctatggactacaagtctgtgtgggcagccatggaagaatgtcagaaacttggcctcacaaagtcgattggtgtcagcaatttctcttgcaagaagcttcaagatttattggccaccgccaacatccctcccgctgttaatcaagtggagatgaacccaatttggcaacagaagaaattgagggagttctgcaaggccaacggtatccttattacagcctactcaccgttgggagccaatggaactccttggggatccagcggagtcgccaatactgaggtgctacaccaaattgctaaggctagagggaagactcatgctcaggtttgtctaaggtgggtatacgagcaaggagtgagtttgttagtaaagagcttcaatgaagagaggatgaaggagaacctgaagatattcgattgggaactgactgcagaagatttgaaacagatcagcgagatcccacagcatcgaggactccctgctgatattttcgtctcagttaacgggcccttcaagactgtcgaagagttctgggatggcgaggtttga

SEQ ID NO: 47 - DNA, 966 bp, Sanguinaria canadensis
atggagattagtgttccaataacgactctgagctccgggagggagatgccaatcttaggtatgggaactgctgaaaatctattcaatggatccgaaaaagtgaaattggcaattctagatgcgataaaagtgggatacagacactttgatacagctgctgtgtaccaaactgagtcgtctttgggtgaagcagtagctgaagcacttcaacatggactgctcaaatctcgagacgaactcttcatcacctccaaattatggtgctctgattctcaccctgatcgtgtcctccctgctcttcaaacctctctcaggaagcttaagttggagtatcttgatctatatctgatacattggccgttaagctctaagcctgggagccatgattatcctatacccaaggaggatttgctccctttggactacaagtctgtgtgggcagccatggaagaatgtcagaagcttggcctcacaaagtcgattggtgtcagcaatttctcttgcaagaagcttcaagatttattggacacagccaacatccctcccgctgttaatcaagtggagatgaacccgctttggcaacagaagaaactgctggagttttgtaaggggaacggtattatcatcactgccttttcgccgttgggtgccaaaggcacctcctggggcgccaccaacggagttatggactctgaggtgctacaccagattgcccaggctagaggaaagtctattgctcaggtttctctgaggtggttatacgagcaaggtgtgagtctggttgtgaagagtttcaatgtagagaggatgaaggagaacctgaagatattcgattgggaattaagcgcagaagacttaaaaaagatcaacgagatcccacagcgtagaggactccctagtggtagtttcatctcagctaacgggccattcaagtctgaagaagagctctgggacggagaagtctga

SEQ ID NO: 48 - DNA, 957 bp, Sanguinaria canadensis
atggccatggaaaccgttcctaagctacccttaagctccggtgacaattccatcccggtaataggtttcggcaccgccgcgtttccactccccgatgacgaaactttaaaatcggcgtttctcaatgggattgaagccggttaccgtcactttgacacggcggctgcctatggttcggagaaggctctcggcgaagctataaccgaagctttacgtctcggtctgctaaaatctcgagaagaagttttcatcaccactaagctttggtgtagcagttgtgaacgcagcctcgtggttccttcactcaagaatagcctccggaatctacaaatggagtacgtagatcttttcctcatacattggcctgtaagattaagtattgatgcacagcgacctccaattccaagggaacaaattcttactttcgatactaaatcagtttgggaaggaatggaagaatgtcacgaacttggcctcgccaaaaatatcggacttagtaatttttatcccaagaagatcgatgaattgctcgccaccgcaaaaattcccccggccgtccttcaagtggaattgagcccaacttggcaacagaagaatttgatcgaatattgtagggaaaagggtatccttgtcacggcttattctgctttaggagccaacggcacgcattggggagacaatagagtggtggagagcgatgtattaggagacatcgccaaggctagaggaaaaaccactgctcagattgcgttgagatgggtgtatgaacaaggggtgtgtatggtggtgaagagcttcaacaaggaaaggatgaaactaaacctccagatctttgattttgagttgaccgaggaagagtcaaacaagatcagtcaacttccacaaatcaaaggagttaaactatctcccatgtttgggaaccatgatgtactcaaggagcttgaggatcaactctga

SEQ ID NO: 49 - DNA, 987 bp, Sanguinaria canadensis
atgggtgaggaaatgaagtgtggtagggttgttccagtggcgactctgaactccggaaggacgatgccgctcttaggtatgggaacagccgcatatccatttgtcgggtcggaaaaggtaaagtctgcgattcttcatgcgataaagctggggtaccggcactttgataccgctgcgctgtaccaaactgaggagtgtcttggtgaagttgtagctgaagcacttcaacttggactgctcaaatctcgagacgaactcttcatcacttccaagctatggtgctctgattctcaccctgaccgtgtcctccctgctcttcagacctcccttcggaagcttaagttggagtaccttgatctatatctgatacattggccgctaagtttgaagcctgggaactacggatttcccatacccaaagaggacatgctccctatggactacaagtctgtgtgggcagccatggaagaatgtcaaaagcttggcctcacaaagtcgatcggtgtcagcaatttctcttgcaagaagcttcaagatttattggccacagccaacatccctcccgctgttaatcaagtggagatgaacccaatttggcaacaaaagaaactgagagagttttgcgaggccaatggtatccttattacagcctactcgcctttaggagccaatggaaccccttggggctccagcggagtcgcccagactcaggtgctgcacgacattgctaaggctagagggaagactcatgctcaggtttgtgtgagatgggtatacgagcaaggggtgagtgtgttggtgaaaagctacaatgaagagaggatgaaggagaacctgacggtattcgattgggaattggacgtagaggacctgaagaagatcagtactgaaatcccacagcgtagaggacttcctagtgacattttcgtttcagtacttactggacccttcaagtctgcagaagagctctgggatggagagctctga

SEQ ID NO: 50 - DNA, 981 bp, Stylophorum diphyllum
atggagagtgatagtacagcagtagcagttccagttacgactctgagctcaggtattgagatgccaatgttaggtctgggaactgctgatgaaaaacttcttccaagttccgaaacagtgaagttggcttttctgactgcgataaaactagggtacaggcacttcgacacagctgctgtgtaccaaactgaggagtgtcttggtgaagctgtagctgaagcacttcaacttggtctgatcaaatctagagacgaactcttcatcacttccaagctgtggtgctctgatgctcaccctgatcttgtcatccctgctcttcagaactctctccggaagctgaagttggagtatcttgatttatatctgatacattggccgttaagctcaaagccagggaactgtgtttttccaatacccaaggaggacctccttcctttggacttcaagtctgtgtgggcagccatggaagaatgtcaaaagcttggcctcacaaagtcaattggtgttagcaacttctcttgcaagaagcttcaagatttactggccatggctatcatcccgcccgctgttaatcaagtggagatgaacccacattggcaacagaagaaactgagggagttttgtaaggtcaaagatattgtcgttacagcctactcgcctctgggagccaaaggcaccccatggggctccaacgcagttatggactccaaggtgctacatcagattgccaaggctagagggaagtctgttgctcaggtttctcttagatgggtataccagcaaggtgtggttttgttggtgaagagtttcaatgaagaaaggatgaaggagaacatgaagatattcaattgggaactgaacgaagaagacttaaaaatgatcgacgagatcccacaatgtagaggcaaccctagtcattattacgtctcagaaaacggaccattcaagactgttgaagaattctgggatggagaagtctaa

SEQ ID NO: 51 - DNA, 924 bp, Stylophorum diphyllum
atgccaattgttggtatgggaacagctgaaaacctttttgaaggttcagaaagagtgaagttggctcttctgactgcaataaaggtgggttatagacactttgatacagctgctgtttaccagactgaggggtctcttggtgaagctatagctgaagcacttcaacttggactgatcaaatctagagacgaactctttataacttccaagctgtggattcatgattgtcaccatgatcttgtcctccctgctcttcagaattctcttaggaagcttaagttggagtaccttgacctctatttgatacattggccagtaagctcgaagccaggggagctcaggtctcttataccaaaggaggagctcctcccaatggatttcaagtctgtgtgggtagccatggaagaatgtcacaagattggcctcacaaagtcaattggtgttagcaacttctcttgcaagaagcttcaagatttattgctcactgccaacatccctcctgctgttaaccaaaaggtggagatgaacccactttggcaacagaagaaactgagggagttttgtaaggccaacggtatcgtcattgcagcttactcgcctttaggagccaaaggaaccttgtggggaaccaacggtgttatggactctgaggtgctacaacagattgccaaggcaagacgaaagtctattgcgcaggtttctctacgatgggtatatgaacaaggggtggttttgttggtgaagagttttaatgaagggaggatgaaggaaaacctgaagatattcgattgggaattaagtagagaagacttgaaacaaatcaacgagatcctcccacagcgtagaggactccctagtcatgtttttgtctccgatgacgggccattcaagtctgaggaagaactgtgggatggagaagtgtga

SEQ ID NO: 52 - DNA, 957 bp, Stylophorum diphyllum
atgaccatggaagctgttccaaaggtaaccttaagcaccagtggcaaatccatgcccataattggtttcggcaccgccttgtttccgactggcaatgacgaagccgtgaaatcagcggttctaagtgggattgaagctggttatcgtcacttcgacacagcagtcgcctacagatccgaaaagggtctcggtgaaggtatagcagaagctctacgtctaggtctgatcttatctcgagacgaagttttcatcaccaccaagctttggtgtactagttgcgagcgcagcctcgttgtaccttcactcaagaacagcctccgaaatctacaaatggaatacgtagatctttttctcatacattggcctttacgactaagtgccgatgcacaacgacctccgattcgaaacgatcagatacttcatttcgatacgaaatcagtttgggaaggaatggaagaatgttatgaactaggcctcgccaaaaatataggagttagtaacttctatcccaagaagattgatgagttactcgccactgcaaaaattcctccagcaatcaatcaagtggaattaaacccagcttggaaccagaaggatctgatcaagtattgtaagtcaaagggtattcttatcacggcttactctgctttaggagccaacggaacgcattggggagataaccgagttgtggacagcgatgtgctgaaggacatcgcgaaagctcgaggaaaatccacagctcaggttgcattgagatgggtatatgagcaaggggtgagtatggtggtcaagagctttaacaaggaaaggatgaaacagaaccttcagatcttcgattttgagttgacggaggaagagtcaaacaagatcagtcaacttccacaacacaaaggtgttaaacttactccagtgtatggcgaccatgatgccatgaagaagattgacaatgagatctga

SEQ ID NO: 53 - DNA, 960 bp, Tinospora cordifolia
atggtgagtgtacctgaggtggttctgagcaacgggcacctcatgcctgtggttggtatgggcatggcggcctacccattccaagaatctgaaacagtgaagcaggcaatgatcagggcaattaagatgggctacaggcattttgacacagctgccttgtaccaaacagagaagtcccttggagatgcaattgtagaagcactaaagcttggcctcattaaatctcgtgacgagcttttcatcacttccaagctgtggtgcagtgatgctcatccccatcacgtcattccggctcttcaaagaactctgaggaatcttgggttggagtaccttgatctctatctcatacactggccagtaagctcagaacctggcaaatacgagttcccagtacgaaaggaagagctaattctgatggattttgaaaatgtatgggcagatatggaagaaggatataggcttggcctcacaaagtcaattggtgtaagcaacttctcttgtaagaagctcgaaagtttactcactatggcaaagatccctcctgcagtgaatcaagtggagatgaatcccctctggagacagaataaactactaaggttttgtaaggacaagggcattgctatcactgcttactcaccactgggagccaaaggaactatatggggcactaacagagtgatggaaagcgaggtgctaaacgatactgccaatgctagagaaaagactcttgctcaggtttgtctaagatgggtttatgagcaagaagtatccatattggtcaaaagcttcaacgaagagaggatgaaggagaacttagacatttttgattggaaattaagtgacgaggacttggaaaagatcaatgagattccacaatgcagaggacttccaggtgatatctttgtatcagatgatgggcccttcaaatctgaagcagagctctgggatggagaaatctga

SEQ ID NO: 54 - DNA, 990 bp, Tinospora cordifolia
atggtgggagttaacaaggagaacgtggtttcatcagtagcaacggtgccggtggtgacgctgaactccggtcataaaatgccagtgctgggaacgggcacagcttcgtttcctgttcctccattagaggaactgaagaaggtgatcatggaagccatggaagtgggctaccgccactttgatacagcagccatgtatcaaagcgaggaagggctcggtgcggccattaaagaggccttagagaagggtctaattaagagcagagatgagcttttcatcactaccaaactttggtgcaataatgcccaaccccatcttgtgctccctgccatccgcgactctctcaggaggctaaggttggaatatgtggacttatatttgattcattatccagtaaggctgaaggaagatttattgagtatggactgcaaggaggatgaaatatttcccattgacataaaatcagtatggtcggcaatggaggaaatacacaatcttggtcttgcaaaatccattggagtcagcaacttcacttgcaagaagctcactgatctacttgctcatgcaaagatccctcctgcggttaatcaggtggaattgcacccagcatggcaacaaaaaaaattaagagaattctgccaggagaaaggcatccaagtcagtgcatattctcctcttggagctaagcaatggggatttgatgttgttcttagcaataagatcatcaaagagattgcccatcacaaaggaaaaacggttgctcagattgctttaaggtggggacatgagcaaggaataattttaatcccaaagagcttcaacaaggaaagattgattcagaatctcctcatatttgattgggagctaactcaagatgaactgaagaagatggcatcaattcaacagtctagaatagccatagcccctgagtttgtgttccctggcagccctttcaaatcctttgaagagttctgggatggagaaatgtga

SEQ ID NO: 55 - DNA, 966 bp, Tinospora cordifolia
atgggaattagcatgcctgacgcaacccttaattccggccatcggattcctctcatcggattcggaaccgcgagtttccccttccctcttgaaggatcagaaactgctacacgggcaatactggaagccatcaagattggttaccggcactttgacacggctgccttgtaccagacagaggttggacttggtgaagcaatagaagaagctcttcatcttggtctcatcgagtcccgtgatgagctcttcattacctccaagctttggtgcactcatggccgccctgagcgcgtccttcctgcaattcgagaatctcttaagaatctgaagctggactaccttgatctttatctgatacacatgccaatgagcttcaagtcagaaaagccatggttcccattacctggagagtttgaagccatggatttcaagtctgtatgggaacagatggaagcatgccagaggcttggccttgcaagatccattggagttagcaacttctcctgcaaaaagctccaactcatcctcactactgcaaatattcctcctgctgtgaatcaagtggagatgaacgccctttggcaacagaataagctgagagagttttgcaagagtgaaggcattgttatcactgcttactctcccttgggaggcaaaggaaccagttggggttcaaatagagttatggaatgtgaagtgataaaagagattgccacggaaaaaggaaaaacacacgctcaggtttgtcttagatggctgtacgagcaaggcgtgagcatggtggtgaagagcttcaacaaagagagaatgaaagagaacttggagatattcgactgggagctcacaagtaaagagtgtgagcagatcaagaagctaccgcaaagcagaggatttactgcacaagggttggtctcagaagatgggcctttcaagtctatagaagatatatgggatggagagatttga

SEQ ID NO: 56 - DNA, 1002 bp, Thalictrum flavum
atgaggaggccacacagcagactagctagtactagagatatgagtagtattgttcctgatgtggttcttagctctggccataaaatgcctcttattggcttcggcacagttgcgtatcctatcgcagcatcagactccataaagacagctatagtcaatggaattaagcatggttacagacactttgatactgcttcagtttaccaaacagaacaactacttggtgaagctatagctgaagcacttcaatttggtcttattaaatctagacaagaacttttcataacttctaagctatggtgcagtgattctcatcatgatcgtgttctccctgctctgcagaatactctcaagactcttcagctagattaccttgatctgtatctcgtacattggccaataagctctaaaccagggaagcacgagttcccaataccgaaagaggaacttcttcccctgcattttgagtctgtatggacagccatggaagagtgtcaggctgttggccttacaaaatcgattggtgtcagtaacttttcttccaagaagcttgagcagctactctccacttccaagattccacctgcggttaatcaagtggagatgaatccaatttggcaacaatataagttgcgagagttttgtaaatccaaaggtatagttattactgccttttctccattgggtgccaaaggaacgtcttggggaactaataaagttatggactcggaggtgttgaatgagattgctcaggctaaaggaaagactcatgctcaggtttgtcttcgatggttgcatgaacaaggcatatgtgtggtagtgaaaagcttcaatgaagaaaggatgaaggagaacctggagatattcgactgggaattgagcccagaggagtccgcattaatccagcaattaccgcagagtagaggaaatactggagaggactttatctcagtcgacgggccattcaagtccttagaagagctatgggatggagagatttga

SEQ ID NO: 57 - DNA, 963 bp, Thalictrum flavum
atgggaagtatacctgaggtaagcttaaactccggtcaccggatgccactcataggcatgggcacagcatcatacccttttgcaggatcagaagtagtaaagtcagctatactcagtgcaatcaaacttggtaacagacactttgacactgctgctttatacaaaacagagcaaattattggagaagctatagctgaagcacttcaacttggtcttatcaaatctagagaagagcttttcattactaccaagctatgggtgaatgatggtcacaaagattgcatcctccctgctcttcaaacatctctcaaaaacctgcagctggactacgttgatctatatcttatacattggccagtatgcatcccaccaggggagttgcgaatgcctggaccaaatgaaaaggttcttcccatagattatgcatctgtatgggaagcaatggaagagtgtcaaaggcatggccttacaaaatcaattggagtcagcaatttcacctgtaagaaacttgaattgatactggcctcagcaaagatcccaccggctgttaatcaggtggaggtgaatccactatggagacaagaaaaagtgataaggttttgcaaggacagaggcattgctgtcacagcttactctcctttgggcactgctggatcagattttatgggcaacagaaacgtggtgcaaagtgagttactgaaagagattgccaaagctacaggaaagacgcatgctcaggtttgtataagatgggtttttgagcaaggagtaggggtaatagttaagagcttcaaggagatgagactggaggagaacattgacatatttgattgggaactaagcaaagaagactctctgaaaattagccgattaccagagagtaaaggctatcccggacatggcttcattagagttgaagggccattcaaatctcttgaggagctttgggatggagagatctga

SEQ ID NO: 58 - DNA, 963 bp, Xanthoriza simplicissima
atgggtagtgttccagagataaccttgaactccggccacagtatgcctgtcttaggcttgggtaccgcatctgttccctttgctggatatgaagtagtgaagtcagcgatactcagtgcgattaagcttggttatagacactttgatacagcagcgttatacagaacagagcagcctctaggagatgctatagctgaagcaattcgccttggcatcatcaaatccagagaagagctttttattacctccagaccatggctcaatgatactcaccacgatcgaatcctccccgctcttcagacgactctccaaaatctccaactggattaccttgatctttatcttatacattggccactgagcataaaaccagggaatatacgattccctggaccagacgaaaagattcttccaatggatttcgagtctgtatgggcagccatggaagagtgccaaaggcttggtctcacaaggtcgattggagtcagtaatttctcctgcaagaaacttgagaagattcttgcctcagcaacgatccctcctgctgttaatcaagtggaggtgaacccactatggcgacaagagaaactgatacagttttgcaagtctaaaggtattgttataacagcttattctcctttgggaactgttggttcaagttttcaaggtaacaacaatatcatggaatgtgaggttctgaaagagattgcagggaacagaggaaagactcatgctcaggtttgtcttagatgggtatatgagcaaggggtttgtttgctggtaaagagcttcaatgaggcgaggctgaaggaaaacatggaaatatttggctgggcattgagtgaggaagaagcaaaccagatcaatcagctgccacagggtagaggatatcctggacataatttcattacgcctgatgggcctttcaaatctgaagaggagctttgggatggagagatataa

SEQ ID NO: 59 - protein, 325 aa, Argemone Mexicana
MEEVIGLETVVPKVTLSSSSGDNSMPVIGFGTAASPMADHEITKAAVLVGIENGYRHFDTAAAYGTEKAVGEAIAEALRLGLIKSRAEVFITTKLWCRSCERDLVVPSLKNSLQDLQTDYVDLFLIHWPVRLRHDAGRPPISRDQILTFDTKSVWEGMEECHELGLAKNIGVSNFSIKKLEELLATAKIPPVLDQVELSPTWHQKNLIEYCKEKGIHVTAYSALGANNTHWGNNRVVESDVLGEIAKARGKTTAQIALRWVYEQGVSMVVKSFNQERMKQNLQIFDFELTEEESNKISQFPQHKGVSLSAVYGDHDILKEMEAEL

SEQ ID NO: 60 - protein, 322 aa, Argemone Mexicana
MENVIPRVTLSSGSVMPILGMGTASYPFVSSEEGKLAILNAIKVGYRHFDTASTYMFEEFLGEAIAEAIQLGLIKSRKELFITSKLWCCDAHPDLVVPSLRNSLRNLKLEYLDLYLIHFPVSLKAGRYEYPPLKEALVLMDYKSVWAAMEECQNLGLTKSIGVSNFSCKKLQTILDYAKIPPSVNQVEMNPVWQQKKLREFCKANDIVITAYSPLGASGTPWGSSRVLDAQVLHEIARAKGKTHAQVCLRWVYEQGVSLLVKTFNEERMKENLRIFDWELTEEDKQKISKIPQHRGLTGDAFVSEHEGAPFKTAEELWDGEV

SEQ ID NO: 61 - protein, 322 aa, Argemone Mexicana
MDMNKHAVVYVPTKVIMGIPVIGFGTSADPPVDFDTTRLAIMQAIENGYRHFDTAALYNSEQPLGEAINEAISRGLIKSRDELFITSKLWCSDTHPQHILPAIQKTLRNLNMEYLDLYLIHWPVSSRHENFEYPIKKEDFLPMDFKKVWAAMEECHKQGLAKFIGVSNFSCKKLDNIMASATISPSVLQVEVNPCWQQKRLIDFCKANGIFVVAYAPLGAVGTIYGTNRVMESDVLKQIAKKRGKSVAQVCLRWAYEQGIGVVVKSFNKERMKQNLEIFDWKLSEEDTKKISEIQQDRACLGMDYTSPYGPYKTIKQLWDEE

SEQ ID NO: 62 - protein, 322 aa, Berberis thunbergii
MEIVPKVTLNSGYQMPLLGFGTAENWPFTKSEAAKRAILCAIKNGYRHFDTASMYQSEESLGEAIVEALHLGLIKSRNELFITSKLWCSDCHQDRVLPALRETLKNLHLDYLDLYLIHWPLSAKPGKHEYPILKDKLLPMDYESVWGAMEECQRLGLSKSIGVSNFSSKKLEQLLKTAKIIPAVNEVEVNPVWHQNKLIEFCKAKGIVVTGYSPLGAKGTTWGTNKVMDSEVLKEIAKTRGKTHAQVCLRWIYEQGVGLVAKSFNEERMKENLEIFDWALTEEESKQISQLPQYKGQNGETFLSAEGPFKTLEELWDEEVAA

SEQ ID NO: 63 - protein, 320 aa, Berberis thunbergii
MEIVPKVTLNSGYQMPLLGFGTAENWPFTKSEAAKRAILCAIKNGYRHFDTASMYQSEESLGEAIVEALHLGLIKSRNELFITSKLWCSDCHQDRVLPALKNTLQNLQLDYLDLYLIHFPLSSKRGKLEYPLQEDETYPMDFGSVWEEMEKCQRVGLTKSIGVSNFSAKKIEHLLTTAKIIPAVDQVEMNPLWQQRTLREYCKTKGIVVTAYSPLGAKGAIWGSNIVMENEVLAEIAKAKGKTHAQVCLRSVYEKGVALVTRSYNEERMKQNLNIFDWNLSKEETKRIDNLPQKRVFLGEGFLSPLGPFKSPEELWDGEM

SEQ ID NO: 64 - protein, 324 aa, Corydalis chelantifolia
MMVSVPEVTLQSSSSDKKMPIMGMGTAAYPFAESDEAKAALLTSIKLGYRHFDTASLYHNEKSVGKAISEALKLGLVKSRDEFYINSKLWCSDSHPDRVIPALQESLKKLGLEYLDMYLIHWPLSLKKGSYEFPIPTDEEILPMDFKAVWAAMEECQKLGLTKSIGVSNFSCKKLETILSTAKIPPVVNQVELNTLWQQTKLNKFCKDNGIVLMAFSPLGAHGSPWGTNRVMECELLHEIAKAKGKTLAQVCLRWIYEQGAGILVKSYNEVRMKENLEIFDWELSAEELKSISELPQHRGFPADSLLSAKGPFRTEEELWDGEI

SEQ ID NO: 65 - protein, 339 aa, Corydalis chelantifolia
MESVACEPGVIEQQQYFIPEVTCGGGSSTTRMRMPVVGMGTASYPFAGSEGVKQALLHAIKLGYWHFDTASFYQTEQSLGEAISEAIQLGLIKSRDELFITSKLWCTDAHKDLVLPALQNTLRNLQLEYLDLYLIHFPISLKPGRYDFPVQSKEDLLPMDFKSIWAKMEECQGLGLTKSIGVSNFSCKKLENLLATAKIPPAVNQVEMNPLWQQKKLREFCKANGITITAHSPLGAKGTNWGTNRVVECEVLHQIAKAKGKSHAQVCLRWVYEQGVSLLVKSFNKERMKENLGIFDWELNAEDLKKISEIPQGRGLPVDGFLSPNGPFKSEEEFWDGEI

SEQ ID NO: 66 - protein, 301 aa, Corydalis chelantifolia
MPVVGFGTAKFPFGDDEAIKLAVLEGIKLGYRHFDTATKYKSEKPLGETIVEAINLGLIKSRDELFITSKLWCGSTERSLIVPSLKTSLQNLQLDYLDLYLIHWPLRFSTDETPTPVPKEQLLPFDTKSVWQAMEECQNLGLTKSIGVSNFSCKKLEELLSTAKITPAVNQVELNTSWQQTKMREFCKGKGIHITGYSPLGSYGTKWGDNRVVENQVLEEIGKPRGKTAVQVCLRWIYEQGASMVVKSFNKERMKANLDIFDWKLTEEELKRISQLPQHKASLPTASFGDHDEVRELDYEI

SEQ ID NO: 67 - protein, 327 aa, Chelidonium majus
MESDSAAAAVVVPVTTLSSGIEMPMLGMGTVENFLPGSETVKLALLNAIKLGYRHFDTAAIYQTEECLGEAVAEALQLGLIKSRDQLFITSKLWCSDAHPDLVIPALQNSLRKLKLEYLDLYLVHWPLSSKPGNCVFPILKEDLLPLDFKSVWAAMEECQKLGLTKSIGVSNFSCKKLQDLLTSAIIPPVVNQVEMNPRWQQKKLREFCKARDIVVTAYSPLGAKGTVYGSGAVMDCEVLHQIAKIRGKSVAQVSLRWVYQQGVTPLVKSFNEERMKENMKIFDWELYEEDLKMIDEIPQSRVNPCYFFLSENGPFKTVEEFWDGEV

SEQ ID NO: 68 - protein, 327 aa, Chelidonium majus
MESSNNAVLVPVITLNSGREMPIVGMGTAENLFQGSERVKLALLTAIKVGYRHFDTAAVYQTEESLGEAIAEALQLGLIKSRDELFITSKLWLPDCHHDLVLPALQNSLRKLKLEYLDLYLIHWPVSSKPGEIKHVIPKEELLPMDFKSVWAAMEECHKLGLAKSIGVSNFSCKKLQDLLVTANIPPDVNQVEMNPLWQQTKLREFCKAHGILVAAYSPLGAKGTAWGRTNGVMDSEVLQQIAKARGKSIAQVSLRWVYEQGVVLLVKSFNEERMKENLKIFDWELSGEDLKKISEILPQRRGLPSHVFVSDDGPFKSEEELWDGEV

SEQ ID NO: 69 - protein, 327 aa, Chelidonium majus
MESSNNAVLVPVITLNSGREMPIVGMGTAENLFQGSERVKLALLTAIKVGYRHFDTAAVYQTEESLGEAIAEALQLGLIKSRDELFVTSKLWIPDCHHDLVLPALQNSLRKLKLEYLDLYLIHWPVSSKPGELRSLIPKEELLPMDFKSVWVAMEECHKLGLTKSIGVSNFSCKKLRDLLLTANIPPAVNQVEMNPLWQQKKLREFCKANGIVIAAYSPLGAKGTAWGRTNDGVMDSELLQKIAKARGKSTAQVSLRWGYEQGVILLVKSFNEERMKENLKTFDWELSGEDLKQINEILPQRRGHSHEFISDNGPFKSEEELWDGEV

SEQ ID NO: 70 - protein, 328 aa, Chelidonium majus
MGEEMIKTSSVEIPVATLSTGRTMPLLGMGTAAYPFVGSDGVVKAILHAIKLGYRHFDTAALYFTEECLGDAVAEALRLGLIKSRDELFITSKLYCCDAHPDRVVPALQNSLRKLKMEYLDLYLIHWPASTHEGNFEFPLQKQDILPLDFKSVWAAMEECQKLGLTKSIGVSNFSCKKLQDLLASAKIPPAVNQVEMNPIWQQNKLREFCKANDIHITAYSPLGANGTPWGSSGVAETQVLHDIAKARGKTHAQVCLRWVYEQGVSVLVKSYNEERMKENLAVLDWELSEENLKKISEIPQRRGLPGDIFVSDNGPFKTVEELWDGEV

SEQ ID NO: 71 - protein, 306 aa, Cocculus trilobus
MPVVGMGLAAYPFQESEVVKLAMLRAIEMGYRHFDTAALYQTEQSLGLAIAEALELGLIKSRDELFITSKLWCSDAHPHLVIPALQRTLKNLGLDYVDLYLIHWPVSSNKPGKYDFPVPKEELVQMDYESVWAAMEEGHRLGLTKSIGVSNFSCKKLENLLTIAKVPPTVNQVEMNPFWRQYKLKEFCKEKGIIITAYSPLGAKGTIWGTNKVMESKVLEDIGIASGKTLAQVCLRWVYEQGVTLLVKSFNEERMKGNLDIFDWELSEKELKKINEIPQSRGLPGDIFVSDDGPFKSEAELWDGEV

SEQ ID NO: 72 - protein, 321 aa, Eschscholzia californica
MGSCSIPVKSLSSGREMPVIGMGTADSNLAGSDASRIALVKAIEVGYRHFDTASIYQSEQNLGDAIAQALELGLIKSRDELFITSKLWSSDSHPDRVVPALQESLRKLKLEYLDLYLIHWPASSTPGIYEFPIPKDEIFPLEYETIWAAMEECQRLGLTKSIGVSNFSSKKLQTILNTATIPPAANQVEMNPVWQQKKLKEFCDANNILLTAYSPLGAKGTSWGSNKVMESEVLKQIAMANGKSVAQVSLRWLYQIGATMVVKSYNAERMKENLKIFDWELSDEDMKAISEIPQRRNFAGDILISSNGPFKSEDELWDGEV

SEQ ID NO: 73 - protein, 323 aa, Eschscholzia californica
MSSYGSVPMKSLNSGSKIHVLGFGTAAYPFVGSDGVKNAILNAIKLGYRHFDTAALYFTEESLGEAVSEALQLGLIKSRDELFITSKLWISDAYPDRVLPAIQKTLRNLKMEYLDLYLIHWPISGKEGNFDLPVPKDCLQELDYKPVWAAMEECQKLGLTKSIGVSNFSCKKLQIILSSATIPPAVNQVEMNPIWHQKKLREFCKANNIMIAAYSPLGAAGTPWGSSGVVETEVLHEIARSRGKTHAQVCLRWVYEQGVIVLVKSFNEERMKENLSVFDWELTDEDLKKISQIPQRRGLPSGDIWVSTEGPFRSEEELWDGEI

SEQ ID NO: 74 - protein, 324 aa, Glaucium flavum
MEMSSAQVVPLMTLNSGKEIPVLGMGTAENHFQGSDGTKDALVNAIKIGYRHFDTAAIYNVEECLGDAIAEALQHGLIKSRDELFITSKLWISDSHPDRVLFALQNSLRKLKLEYLDLYLIHWPLSSTPGKSVFPVPKEDFLPLDFKSVWAAMEECQKLGLTKSIGVSNFSCKKLQDLLDIANIPPAVNQVEMSPLWQQKKLREFCKVNGILVTAYSPLGAKGTFWGSNEIMDSHVLQEIAKARGKSVAQVTLRWVYEQGVILLVKSFNENRMKENMAIFDWDLSIDDLKKFDEISQRRGNLGDFFVSENGPFKSVDMVWDGEV

SEQ ID NO: 75 - protein, 326 aa, Glaucium flavum
MESSSSSAVVVPVMTLNSGKEMPVLGMGTAENNLQGSEKTKLALLTAIKAGYRHFDTASAYNTEEALGEAVAEALQLGLIKSRDELFITSKLWCSDAHPGLVVPALQNSLRNLKLEYLDLYLIHWPVSLKPGKFVIPFSKEDILPLDFKNVWAAMEECQKLGLAKSIGVSNFSCKKLQDLLAIANIPPAVNQVEMSPLWQQKKLREFCKVNGILVTAYSPLGAKGTFWGSNEIMDSDVLNQIAKARGKSVAQVSLRWVHEQGVILLVKSFNENRMKENMAIFDWELSNDDLKKMDEISQRRGPLADIFVSENGPFKSVDMLWDGGF

SEQ ID NO: 76 - protein, 326 aa, Glaucium flavum
MGSSDAVVVPVKTLSSGRKMPVIGMGTAEILLVDGSEKVKLALLNAIKIGYRHFDTAAVYRTEEALGEVVAEAIQLGLIKSRDELFITSKLWLSDSHPDLVLPALQNSLRKLKFEYLDLYLIHWPLSSKPGELKVLIPKEELLPLDFKSVWAAMEECQKLGLTKSIGVSNFSCKKLQDLLDIANIPPAVNQVEMNPLWQQKKLNEFCKANDIVITAYSPLGAKGTPWGSNRVMDSEVLNQIAKARGKSVAQVALRWVYEQGVSLVVKSFNEERMKENVTKIFDWELSAEDLKKIEEIPQCRGVPSHVFVSVNGPFKSEEELWDGEI

SEQ ID NO: 77 - protein, 327 aa, Glaucium flavum
MGEEMKIKSVEIPVVTLSSGRTMPVFGMGTAAFPFVGSDGVVKAITHAIKLGYRHFDTAALYFTEESLGDAIAEALRLGLIKSRDELFITSKLWCCDAHPDRVLPALRNSLRNLKIEYLDLYLIHWPASTHEGNLEFPIQKQDIHPLDYNSVWAAMEECQTLGLTKSIGVSNFSCKKLQHILAIAKIPPAVNQVEMNPIWQQKKLREFCKANDIHITAYSPLGANGTPWGSSGVVETQVLHDIAKARGKTHAQVCLRWVYEQGVIVLVKSYNEERMKENLTVFDWELSAEDSMKISEIPQHRGLPGDIFVSDSGPFKSEEELWDGEV

SEQ ID NO: 78 - protein, 319 aa, Hydrastis canadensis
MGSVPNVILSSGHPMPLVGFGTAGFPFGTSEGIKSAILCGIKNGYRHFDTASVYQTEQILGEAIAEALELGLIKSRDELFLTSKLWCSDAHQQHVLPALQKTLRTLQLDYLDLYLVHWPLSSKPGKYEYPIPKEELLPMDFKSVWAAMEECQALGLTKSIGVSNFSCKKLEQLLSTSNIPPAVNQVEVNPIWQQNKLREFCKAKGIIVAAFSPLGAKGTSWGTNKVMDSEVLNEIAQARGKTTAQNCLRWLHEQGVCVVVKSFNEERMKGNLKLFDWELSKEESKKISQLPQSKGHTGDDMVSANGPFKSLEELWDGEI

SEQ ID NO: 79 - protein, 319 aa, Hydrastis canadensis
MTRIPEIVLNSGWRMPVLGMGTATFPIQSPEVIESSIVNAIELGYRHFDTASVYQSESPLGRAISEAIRRGLIESRKEVFITSKLWCTDAHHDLVIPALHKTLQNLGLEYLDLYLIHFPVRLKGDISFDIKKADLIPFDVKGTWEAMEKCQELGLTRSIGVSNFSSKKLSELLTHATISPAVNQVEMHPFWQQKELRAFCADKGIHVSAYSPLGGKGALWGSDILLNSKEIERIAQAKGKSIAQVCLRWAYEQGVSYLPKSYNKGRMKENMEIFDWQLSEDELQKISHLPQGKIYTGHHFISDDGEYKSPIDLWDCEIC

SEQ ID NO: 80 - protein, 320 aa, Hydrastis canadensis
MGIVREVVLNSGERMPLLGMGTATYPVAPFELVESSVIAAIELGYRHFDTASVYETEQPLGLAISEAVRQGLIASRDEIFITTKLWCGHAHYDLVLPALRDSLETMGLDYVDLYLIHFPARFNMKEKSLNVNKKDLLPLDIRGTWKAMEECYELGLAKSIGVSNFSCKKLSQLLSVANIPPAVNQVEMHPLWQQQKLREFCEEKGIHVSAYSPLGGKGTIWGSNAVLDSDQIKQIAKAKGKSIAQICLRWGFEHGVSILPKSFNKERLKENMEIFDWELSKEELQKMNTFPQNRIFQAEHLVSPDEGLFKSVADLWDGEI

SEQ ID NO: 81 - protein, 328 aa, Jeffersonia diphylla
MCFCVLVTKRAMGIVPEVTLNSGHQMPLVGFGTAQFPFPEGDEAKQIIAPILCGIKSGYRHFDTASLYKTEEALGEAIKEALRLGLIKSRDELFITSKLWCTDSHQDLVLPALKKTLQNLQMDYLDLYLVHFPVSSKPGKPEFPPQKEDLLPMDFGSVWAAMEECQRLGLTKSIGVSNFSCKKLEQLLTTAKIIPAVNEVEMSPVCQQNKLREFCKVKNIVVTAYSPLGGGSNAVKDNKVLKEIAKAKGKTCAQVTLRWVYEQGVALVPKSFNEGRMKENLDIFNWTISEEEFKQISQLPQGRVATGEWFVSVEGPFKSLEELWDEVI

SEQ ID NO: 82 - protein, 321 aa, Mahonia aquifolium
MGVVPVVTLNSGHEMPLVGFGTAVPAFGGSDAIKQAILCGIKNGYRHFDTASVYQTEKSLGEAIVEALRLGLIKSRDELFITSKLWCTDAHQDGVLPALRETLKNLQLDYLDLYLIHWPLSAKPGKHEYQIPKDELLPMDYESVWGAMEECQRLDLSKSIGVSNFSIKKLEELLKTAKIIPAVNEVEVNPVWHQNKLIEFCKAKGIVVTGYSPLGAKGTTWGTNRVMDNEVLKEIAKTRGKTHAQVCLRWIYEQGVGLVAKSFNEERMKENLEIFDWALTEEESKQISQLPQYKGQNGETFLSAEGPFKTLEELWDEEIAA

SEQ ID NO: 83 - protein, 320 aa, Menispermum canadense
MASVPEVTLSSGHPMPLFGFGTAAWPFVSSEGAKSAILCGMELGYRHFDTASIYGTESSLGEAIAEALKLGIIKSRDELFITSKLWCCDGHHDRVLPALQMTLKNLQLDYIDLYLEHWPLSSVPKGELEYPIPKEKLFPMDLKAVWEAMEECQRLGLTKSIGVSNFSCKKLEDLLAFAKIPPAVNEVEMNPVWQQKKLRDFCKAKGIVLTAYSVLGAKGTLWGTNKVMDSEVLGKIAKARGKTVGQVCLRWAYEQGACVLVKSFNEERMKENLETFNWELGEEDLKMISEIPQYKGLRGEDMVAPNGPYKTLEELWDGEI

SEQ ID NO: 84 - protein, 341 aa, Menispermum canadense
MGVDKTNEFSNGNAASPVLIKEANLFKIAEVTLNSGHHMPVLGTGTASFPFPPLKELKKAIVEAMEVGYRHFDSAALYQSEEGLGAAIAEALEKGLVKKREELFITTKLWCNNAHSDRVLPAIRESLRKLRLDYVDLYLIHFPVRLKEDLLDMNCKKGGIFELDLKSVWAAMEQIQHLGLAKSIGVSNFTCKKLTDLLSYAKIPPAVNQVEMHPVWQQKKLRDFCKEKGIHVSAYSPLGAKQWGFDVVLGNKILKEIAQDKGKTIAQIALRWGYEQGVILIPKSFNKGRLTENLRIFDWKLTEDELKKISSIQQSRVAIMPEFVFPESPFKTFEDFWDGEM

SEQ ID NO: 85 - protein, 322 aa, Menispermum canadense
MEGGGVPKILLNSGHRMPVLGMGTASFPISPQHLVKSSILTAIELGYTHFDTASVYETEPTLSRAIRQALEGRHIASRDQLFITTKLWCGQAQSDLVVPALRESLQELGLDYVDLYLIHFPARFKCVEKTFNVTKEDLLPLDMKGTWQAMEECCKLGLAKSIGVSNFSCKKLSQILTFATIPPAVNQVEMHPLWQQRKLREFCKEKGIHVSAYSPLGGKGAKWGSNAVFECEEIKQIAEAKGKSLAQICLRWAFEQGVSFVPKSFNKERLKENMEIYGWELSKEELQKLSVLPQCRIFKGEWLVSADHGVFKSVEDLWDGEI

SEQ ID NO: 86 - protein, 319 aa, Nandina domestica
MVSVPEVTLNSGHRMPLVGMGTACFPLPGSEVVKSAMVTAIKLGYRHFDTAALYQSEQPLGEAIAEALHLGLIISRDELFITSKLWCTDAHQDLVLPALKTSLRNLQLDYLDLYLIHFPVSLKPGKIQLPVPKEELLPMDFKSVWAAMEECQKLGLTKSIGVSNFSCKKLEHILSLAKIPPAVNQVELNPIWRQKKLIEFCKAKGIVVTAYSPLGAVAPGQGSNRVMECEVLSEIAKARGKTHAQVCLRWIIEQGVSLVVKSFNEDRKKKNLEIFDWELSEEDSKKISQIPETRGNPGDFVISVDGPYKSREELWDGEI

SEQ ID NO: 87 - protein, 319 aa, Nandina domestica
MGRVPETTLSSGHNMPLLGMGTATFPLPPSELIESYILAAIEMGYRHFDTASVYDTEVPLGRAISEALRRGLVANRDELFITTKLWCGHAHPDLVVPALHQSLMEMGLEYVDLYLIHFPARFNKKEKNFDVKKEEVIPLDMKGTWEAMEECSKLGLAKSIGVSNFSCKKLSQLLTYATIPPAVNQVEMHPLWQQWKLREFCVANDIHVTAYSPLGGKGALWGSNSVLDSKEIQQMAEAKGKSIAQICLRWAFEQGVSFIPKSFNVERLKENMEIFDWEMNKNELLKMSLLPQKRTFTAEYLVSPDGAFKSVDDLWDGEI

SEQ ID NO: 88 - protein, 319 aa, Nigella sativa
MARVPEITLNSGHRMPLLGMGTAVVPFKEPEPVKSAILTAIKNGYRHFDTASLYRTEPALGDAIAEALQLGLINSRDDLFITSKLWCTDNHPDLVLPALHTTLRNLKLDYLDLYLIHWPVSMTPGRIRFPGPDEKILPMDYKSVWAAMEECQKLGLTKSIGVSNFTCKKLELLLASATIPPAVNQVEVNPMWQQEKLIEFCRTKGIVVTAYAPLGTVGTFIGNNDIMNCELLKEIAQAKGKTNGQICLRWVHEQGVGLLVKSFTEVRMKQNLEIFDWELSEEESMKIKQLPQRKSHQGKGFVTADGPFKSLTELWDGEM

SEQ ID NO: 89 - protein, 317 aa, Nigella sativa
MVYEIMLNSGYRIPLLGMGTAAYPVPPPELVESSVLAAIELGYRHFDTAHIYGTEAPLGRAISEALRKGLIKSRDELFITTKLWPGHARPDLVLQALHQSLEALRIDYVDLFLIHFPARYNTTEIRMDIKKEDILPLDIKGTWQAMEECCKLGLAKSIGVSNFGCKKLSQLLDSATIPPAVNQVEMHPLWQQAKLREFCAERGIHVSAYSPLGGKGTLWGSNAVLDSEQIKQIALAKGKSVAQICLRWGFQQGVSIIAKSFNRERLKENMEIFDWELNKEELYKLSILPQNRISTLEYLVSPDAVFKSINDLWDEEV

SEQ ID NO: 90 - protein, 318 aa, Nigella sativa
MDNSVVVLNSGHRMPLLGMGTAATPLPPNEVVQSSVLAAIELGYRHFDTASVYGSEVILGRAISEALRRGLVASRDELFITTKLWCGNGHPDLVLGALQESLRIMELDYVDLYLIHFPVRFNITEKLLNMKNVPLLPFDMEGTWQAMEECCRLGLAKSIGVSNFSCKRLSELLLSASIPPAVNQVEMHPLWQQRNMREFCRKEGIHVSAYSPLGGKGAAWGSNAVLDSEDIQQIAQHKEKSVAQVCLRWAFEQGVSIIVKSFNKERLKENTQIFDWELNKQELQRINTLPQNKIFKASNLISADGPYKTFEELWDGEV

SEQ ID NO: 91 - protein, 321 aa, Papaver bracteatum
MESNGVPMITLSSGIRMPALGMGTVETMEKGTEREKLAFLKAIEVGYRHFDAAAAYQTEECLGEAIAEALQLGLIKSREELFITSKLWCTDAHADLVLPALQNSLRNLKLEYLDLYLIHFPVSLKPGKIVSDIPKDQMLPMDYKSVWAAMEECQTLGFTRAIGVSNFSCKKLQELMATANSPPVVNEVEMSPIFQQKKLRAYCKANNIMITAYSVLGARGAAWGSNAVMDSKVLHEIAVSRGKSVAQVSMRWVYQQGACLVVKSFNEERMKENLKIFDWELSAEDMEKISEIPQSRTSSADFLLSPTGPFKTEEEFWDEKD

SEQ ID NO: 92 - protein, 321 aa, Papaver bracteatum
MEINGVPVISLSSGVRMPALGMGTAETMEKGTDRERSAFLKAIEVGYRHFDTAAAYQTEECLGEAIAEALQLGLIKSRDELFITSKLWCTDAHADLVLPALQNSLRNLKLEYLDLYLIHAPVSLKPGKILNEIPKDQMLPMDYKSVWAAMEECQTLGFTRAIGVSNFSCKKLQELMATANSPPVVNEVEMSPTLHQKNLREYCKANNIMIIAYSVLGARGTGWGSNAVMDSKVLHQIAVARGKSVAQVSMRWVYQQGACLVVKSFNEERMKENLKIFDWELTEEDMDKISEIPQSRTLSADFLLSPTGPFKTEEEFWDEMV

SEQ ID NO: 93 - protein, 323 aa, Papaver bracteatum
MRNTGVPVITLSSGKGIPVLGMGTFETVGKGGERERLAFLKAIEVGYRHFDTAACYQTEECLGEAIEEALQLGLIKSRDELFITSKLWCTDAHPDRVLLALQNSLRNLKLEYLDLYLIHFPVSLKPGNEVTMDAAGGEIFLMDYKSVWAAMEECQNLGFTKSIGVSNFSCKKLQELLATANIPPVVNQVEMSPVFHQKNLREYCKANNILVAAYSILGGKGTAWGSNSVLGSEGLNQIAIARGKSIAQVSMRWVYEQGAILVVKSFSEKNMRENLNIFDWELTKEDLERIGEIPQRRLIIQEFMVSSNGPFKSLEEFWDEKAD

SEQ ID NO: 94 - protein, 321 aa, Papaver bracteatum
MENVIPAVTLSSGSVMPILGMGTAAYPLVEPEEAKLAFLNAIKIGYRHFDTAASYHCEGFLGEAIAEALQLGLIKSRDELFITSKLWPCDAHPDLVIPAIQNSLRNLKLEYLDLYLIHFPISTKPAAGLVFPPPKDALLPMDYKSVWAAMEECQKLGLTKSIGVSNFSCKKLQTILDIANIPPAVNQVEMNPVWQNLKLRDFCKANNIVLTAYSPLGARGTPWGSNAVYEERVLHEIAEAKGKTHAQVCLRWVYEQGVSLIVKSFNELRMKENMMIFDWELTEDELQKIGKIPQRRGLPGDFFVSEAAPFKTVEEFWDGEI

SEQ ID NO: 95 - protein, 322 aa, Papaver bracteatum
MEVVIPKVALSSGRVMPVLGMGTSSFPPVGPEDGKAAILNAIKIGYRHFDTASVYKSEDFLGEAIAEALLLGLIQSRDQLFITSKLYCNDAHPDLVVPALQNSLRNLRLEYLDLYLIHFPVSSKPVKYEYHLKKEHLLPMDYESVWAAMEKCQKLGLTKSIGVSNFSCKKLQTILDTANISPAVNQVEMNPVWQNLKLRDFCKAKGIVVTAYSPLGASGTPWGSNAVKEAQELHEIAKARGKTHAQVCLRWVYEQGVSLLVKSFKEERMKENLMIFDWELTKDDLFKISKITQRRGLPGYRFISKLEGSPFKTVEEFWDGEV

SEQ ID NO: 96 - protein, 321 aa, Papaver bracteatum
MESSGVPVITLRSGKVMPVLGMGTFEKAGKGSERERLAILKAIEVGYRYFDTAAAYETEEVLGEAIAEALQLGLIKSRDELFISSMLWCTDAHPDRVLLALQNSLRNLKLEYVDLYMLPFPASLKPGKITMDIPEEDICPMDYRSVWSAMEECQNLGLTKSIGVSNFSCKKLEELMATANIPPAVNQVEMSPAFQQKKLREYCNANNILVSAVSILGSNGTPWGSNAVLGSEVLKKIAMAKGKSVAQVSMRWVYEQGASLVVKSFSEERLRENLNIFDWQLTKEDNEKIGEIPQCRILSAYFLVSPKGPFKSQEELWDDKA

SEQ ID NO: 97 - protein, 323 aa, Papaver bracteatum
MGSSCIPVLTLNSGNKMPVLGMGTFETFAKGGERERLAYLKAIKVGYRYFDTGAAYGTEEVLGQAIAEALQLGLIKSRDELFISTMIWATDAHPDGVLPAVQRSLRNLKLDYVDLYLIPFPASLNPEGEIPNYIPENETFLKMDYKSVWAAMEECQTLGFTKSIGVSNFSCKKLQEVMETANIPPAVNMVEMNPTFQQKYLREYCKANNILVNAYSVLGSTGTSWGSNAVMGSEVLKQIATDIGKSIAQVSMRWVYEQGAGFVVKSFSEERMRENLNIFDWELTKEDLEKISQIPQCRVLPMDFLVSSDGAFKSLEDLWDGEA

SEQ ID NO: 98 - protein, 303 aa, Papaver bracteatum
MPILGFGTAENLFEGGDKVKLAILKAIEVGYRYIDTAAVYRTEESVGEAVAEALQLGLIKSRDELFITSKLWGVDAHPDLVLPALQNSLRKLKLEYLDLYLIHYPVSLKPGEMVDDIPKDEIFPLDYKSVWAAMEECQKLGYTKSIGVSNFSCKKLQQLMATANIPPAVNQVEMNPTWQQKNLREYCKANNIFITAYSTLGAKDLLWGSNAVLGSKVLNQIAVARGKSVAQVSLRWVYEQGVSLVVKSFNEERMKENLKIFDWELTTEDLKMISEIPQRRVATADFFVSDIGPFKSLEELWDE

SEQ ID NO: 99 - protein, 306 aa, Papaver bracteatum
MPVLGLGTAENLTKGSEREMLAILKAIEVGYRHFDTAFIYQTQECVGEAIAEALQLGIIKSRDELFITSKLWGSDAHPDCVLLALQNSLRNLKLQYLDLYLIHYPVSLKPGTTLKDLGNKDNFLPMDYKSVWAAMEECQKLGLTKSIGVSNFSSKKIQELMSTDSIPPAVNQVEMNPTWQQKKLREYCQANNILVTAYSPLGAKGTTWGSNAVMGSEVLNQIALARGKSVAQISLRWVYEQGVSLVVKSFNEERMRENLKIFDWELTAEDLKKIDELPQSRVATAEFVVSENGPFKSLEEFWDDES

SEQ ID NO: 100 - protein, 321 aa, Papaver bracteatum
MENAIPAVTLNSGSVMPVLGMGTAAYPFVESEEAKLAILNAIKTGYRHLDTAALYQSEESLGEAVSEAIQLGLIKSRDELFITSKLWPCDAHPDLVIPAIQNSLRNLKLEYLDLYLIHFPISTKPAAGLVFPPPKDALLPMDYKSVWAAMEECQKLGLTKSIGVSNFSCKKLQTILDIANIPPAVNQVEMNPVWQNLQLRDFCKDKSIILTAYSPLEGKGTPWGSNAVYGAQVLHEIAEAKGKTHAQVCLRWVYEQGVSLLVKSFNDQRMKENMMIFDWELTEDELEKISRIPQRRGLPGDFFVSEAAPFKTVEEFWDGEI

SEQ ID NO: 101 - protein, 321 aa, Papaver bracteatum
MENAIPAVTLNSGSVMPVLGMGTAAYPFVESEEAKLAILNAIKTGYRHLDTAALYQSEESLGEAVAEAIQLGLIKSRDELFITSKLWPCDAHPDRVVPTLQNSLRKLKLEYLDLYLIHWPVSSNPVAGHVLSLPKDSLVTMDYESVWAAMEECQKLGLTKSIGVSNFSCKKLQTILDIANIPPAVNQVEMNPVWQNLKLRDFCKANNIVLTAYSPLGARGTPWGSNAVYEERVLHEIAEAKGKTHAQVCLRWVYEQGVSLIVKSFNELRMKENMMIFDWELTEDELQKIGKIPQRRGLPGDFFVSEAAPFKTVEEFWDGEI

SEQ ID NO: 102 - protein, 323 aa, Papaver bracteatum
MENVIPAVTLSSGSVMPILAMGTAAYPLVEPEEAKLAFLNAIKIGYRHFDTAASYHCEGFLGEAIAEALQLGLIKSRDELFITSKLWPCDAHPDLVIPAIQNSLRNLKLEYLDLYLIHFPISTKPAAGLVFPPPKDALLPMDYKSVWAAMEECQKLGLTKSIGVSNFSCKKLQTILDIANIPPAVNQVEMNPVWQNLQLRDFCKDKSIILTAYSPLEGKGTPWGSNAVYGAQVLHEIAEAKGKTHAQVCLRWVYEQGVSLLVKSFNDQRMKENMMIFDWELTEDELEKIGKIPQSRGLPGDVFVSELEAAPFKTVEEFWDGEV

SEQ ID NO: 103 - protein, 319 aa, Sanguinaria canadensis
MENVSVVTLNSGREMPILGMGTAAYPSVGSEEAKLAILLAIKVGYRHFDTAAAYQIESSLGEAVAEALQLGLLKSRDELFITSKLWCSDSHPERVLPALQNSLRNLKLEYLDLYLIHWPVSLKPGNFDLTIPKEDLLPMDYKSVWAAMEECQKLGLTKSIGVSNFSCKKLQDLLATANIPPAVNQVEMNPIWQQKKLREFCKANGILITAYSPLGANGTPWGSSGVANTEVLHQIAKARGKTHAQVCLRWVYEQGVSLLVKSFNEERMKENLKIFDWELTAEDLKQISEIPQHRGLPADIFVSVNGPFKTVEEFWDGEV

SEQ ID NO: 104 - protein, 321 aa, Sanguinaria canadensis
MEISVPITTLSSGREMPILGMGTAENLFNGSEKVKLAILDAIKVGYRHFDTAAVYQTESSLGEAVAEALQHGLLKSRDELFITSKLWCSDSHPDRVLPALQTSLRKLKLEYLDLYLIHWPLSSKPGSHDYPIPKEDLLPLDYKSVWAAMEECQKLGLTKSIGVSNFSCKKLQDLLDTANIPPAVNQVEMNPLWQQKKLLEFCKGNGIIITAFSPLGAKGTSWGATNGVMDSEVLHQIAQARGKSIAQVSLRWLYEQGVSLVVKSFNVERMKENLKIFDWELSAEDLKKINEIPQRRGLPSGSFISANGPFKSEEELWDGEV

SEQ ID NO: 105 - protein, 318 aa, Sanguinaria canadensis
MAMETVPKLPLSSGDNSIPVIGFGTAAFPLPDDETLKSAFLNGIEAGYRHFDTAAAYGSEKALGEAITEALRLGLLKSREEVFITTKLWCSSCERSLVVPSLKNSLRNLQMEYVDLFLIHWPVRLSIDAQRPPIPREQILTFDTKSVWEGMEECHELGLAKNIGLSNFYPKKIDELLATAKIPPAVLQVELSPTWQQKNLIEYCREKGILVTAYSALGANGTHWGDNRVVESDVLGDIAKARGKTTAQIALRWVYEQGVCMVVKSFNKERMKLNLQIFDFELTEEESNKISQLPQIKGVKLSPMFGNHDVLKELEDQL

SEQ ID NO: 106 - protein, 328 aa, Sanguinaria canadensis
MGEEMKCGRVVPVATLNSGRTMPLLGMGTAAYPFVGSEKVKSAILHAIKLGYRHFDTAALYQTEECLGEVVAEALQLGLLKSRDELFITSKLWCSDSHPDRVLPALQTSLRKLKLEYLDLYLIHWPLSLKPGNYGFPIPKEDMLPMDYKSVWAAMEECQKLGLTKSIGVSNFSCKKLQDLLATANIPPAVNQVEMNPIWQQKKLREFCEANGILITAYSPLGANGTPWGSSGVAQTQVLHDIAKARGKTHAQVCVRWVYEQGVSVLVKSYNEERMKENLTVFDWELDVEDLKKISTEIPQRRGLPSDIFVSVLTGPFKSAEELWDGEL

SEQ ID NO: 107 - protein, 326 aa, Stylophorum diphyllum
MESDSTAVAVPVTTLSSGIEMPMLGLGTADEKLLPSSETVKLAFLTAIKLGYRHFDTAAVYQTEECLGEAVAEALQLGLIKSRDELFITSKLWCSDAHPDLVIPALQNSLRKLKLEYLDLYLIHWPLSSKPGNCVFPIPKEDLLPLDFKSVWAAMEECQKLGLTKSIGVSNFSCKKLQDLLAMAIIPPAVNQVEMNPHWQQKKLREFCKVKDIVVTAYSPLGAKGTPWGSNAVMDSKVLHQIAKARGKSVAQVSLRWVYQQGVVLLVKSFNEERMKENMKIFNWELNEEDLKMIDEIPQCRGNPSHYYVSENGPFKTVEEFWDGEV

SEQ ID NO: 108 - protein, 307 aa, Stylophorum diphyllum
MPIVGMGTAENLFEGSERVKLALLTAIKVGYRHFDTAAVYQTEGSLGEAIAEALQLGLIKSRDELFITSKLWIHDCHHDLVLPALQNSLRKLKLEYLDLYLIHWPVSSKPGELRSLIPKEELLPMDFKSVWVAMEECHKIGLTKSIGVSNFSCKKLQDLLLTANIPPAVNQKVEMNPLWQQKKLREFCKANGIVIAAYSPLGAKGTLWGTNGVMDSEVLQQIAKARRKSIAQVSLRWVYEQGVVLLVKSFNEGRMKENLKIFDWELSREDLKQINEILPQRRGLPSHVFVSDDGPFKSEEELWDGEV

SEQ ID NO: 109 - protein, 318 aa, Stylophorum diphyllum
MTMEAVPKVTLSTSGKSMPIIGFGTALFPTGNDEAVKSAVLSGIEAGYRHFDTAVAYRSEKGLGEGIAEALRLGLILSRDEVFITTKLWCTSCERSLVVPSLKNSLRNLQMEYVDLFLIHWPLRLSADAQRPPIRNDQILHFDTKSVWEGMEECYELGLAKNIGVSNFYPKKIDELLATAKIPPAINQVELNPAWNQKDLIKYCKSKGILITAYSALGANGTHWGDNRVVDSDVLKDIAKARGKSTAQVALRWVYEQGVSMVVKSFNKERMKQNLQIFDFELTEEESNKISQLPQHKGVKLTPVYGDHDAMKKIDNEI

SEQ ID NO: 110 - protein, 319 aa, Tinospora cordifolia
MVSVPEVVLSNGHLMPVVGMGMAAYPFQESETVKQAMIRAIKMGYRHFDTAALYQTEKSLGDAIVEALKLGLIKSRDELFITSKLWCSDAHPHHVIPALQRTLRNLGLEYLDLYLIHWPVSSEPGKYEFPVRKEELILMDFENVWADMEEGYRLGLTKSIGVSNFSCKKLESLLTMAKIPPAVNQVEMNPLWRQNKLLRFCKDKGIAITAYSPLGAKGTIWGTNRVMESEVLNDTANAREKTLAQVCLRWVYEQEVSILVKSFNEERMKENLDIFDWKLSDEDLEKINEIPQCRGLPGDIFVSDDGPFKSEAELWDGEI

SEQ ID NO: 111 - protein, 329 aa, Tinospora cordifolia
MVGVNKENVVSSVATVPVVTLNSGHKMPVLGTGTASFPVPPLEELKKVIMEAMEVGYRHFDTAAMYQSEEGLGAAIKEALEKGLIKSRDELFITTKLWCNNAQPHLVLPAIRDSLRRLRLEYVDLYLIHYPVRLKEDLLSMDCKEDEIFPIDIKSVWSAMEEIHNLGLAKSIGVSNFTCKKLTDLLAHAKIPPAVNQVELHPAWQQKKLREFCQEKGIQVSAYSPLGAKQWGFDVVLSNKIIKEIAHHKGKTVAQIALRWGHEQGIILIPKSFNKERLIQNLLIFDWELTQDELKKMASIQQSRIAIAPEFVFPGSPFKSFEEFWDGEM

SEQ ID NO: 112 - protein, 321 aa, Tinospora cordifolia
MGISMPDATLNSGHRIPLIGFGTASFPFPLEGSETATRAILEAIKIGYRHFDTAALYQTEVGLGEAIEEALHLGLIESRDELFITSKLWCTHGRPERVLPAIRESLKNLKLDYLDLYLIHMPMSFKSEKPWFPLPGEFEAMDFKSVWEQMEACQRLGLARSIGVSNFSCKKLQLILTTANIPPAVNQVEMNALWQQNKLREFCKSEGIVITAYSPLGGKGTSWGSNRVMECEVIKEIATEKGKTHAQVCLRWLYEQGVSMVVKSFNKERMKENLEIFDWELTSKECEQIKKLPQSRGFTAQGLVSEDGPFKSIEDIWDGEI

SEQ ID NO: 113 - protein, 333 aa, Thalictrum flavum
MRRPHSRLASTRDMSSIVPDVVLSSGHKMPLIGFGTVAYPIAASDSIKTAIVNGIKHGYRHFDTASVYQTEQLLGEAIAEALQFGLIKSRQELFITSKLWCSDSHHDRVLPALQNTLKTLQLDYLDLYLVHWPISSKPGKHEFPIPKEELLPLHFESVWTAMEECQAVGLTKSIGVSNFSSKKLEQLLSTSKIPPAVNQVEMNPIWQQYKLREFCKSKGIVITAFSPLGAKGTSWGTNKVMDSEVLNEIAQAKGKTHAQVCLRWLHEQGICVVVKSFNEERMKENLEIFDWELSPEESALIQQLPQSRGNTGEDFISVDGPFKSLEELWDGEI

SEQ ID NO: 114 - protein, 320 aa, Thalictrum flavum
MGSIPEVSLNSGHRMPLIGMGTASYPFAGSEVVKSAILSAIKLGNRHFDTAALYKTEQIIGEAIAEALQLGLIKSREELFITTKLWVNDGHKDCILPALQTSLKNLQLDYVDLYLIHWPVCIPPGELRMPGPNEKVLPIDYASVWEAMEECQRHGLTKSIGVSNFTCKKLELILASAKIPPAVNQVEVNPLWRQEKVIRFCKDRGIAVTAYSPLGTAGSDFMGNRNVVQSELLKEIAKATGKTHAQVCIRWVFEQGVGVIVKSFKEMRLEENIDIFDWELSKEDSLKISRLPESKGYPGHGFIRVEGPFKSLEELWDGEI

SEQ ID NO: 115 - protein, 320 aa, Xanthoriza simplicissima
MGSVPEITLNSGHSMPVLGLGTASVPFAGYEVVKSAILSAIKLGYRHFDTAALYRTEQPLGDAIAEAIRLGIIKSREELFITSRPWLNDTHHDRILPALQTTLQNLQLDYLDLYLIHWPLSIKPGNIRFPGPDEKILPMDFESVWAAMEECQRLGLTRSIGVSNFSCKKLEKILASATIPPAVNQVEVNPLWRQEKLIQFCKSKGIVITAYSPLGTVGSSFQGNNNIMECEVLKEIAGNRGKTHAQVCLRWVYEQGVCLLVKSFNEARLKENMEIFGWALSEEEANQINQLPQGRGYPGHNFITPDGPFKSEEELWDGEI

SEQ ID NO: 116 - DNA, 1599 bp, Argemone mexicana
atggataattttcttctccagttccaaccaatttcaattgcagctttttttgttgccctagtttttctgtattggagttatggaagaaaaagcaacaaaaccctaaaaccaagagcaccagaagcagcaggaggaagaccaataacaggtcatcttcatcttttttatggagaagaattaactcatcgaaaactaggttccatggctgataaatatggaccagttttcaatattagatttggttcacataaaaccctagttgtaagtaattgggaaatcgttaaagaatgtttcactacaaatgatcgattattctcaaatcgaccaggtactttagctattaaactaatgttttatgatactgattcagtaggttatgcaccttatggaaattactggagagaattaagaaaaatttcaactttaaaacttctctctaatcatagaatagaaaccctaaaacatttaagaacttctgaagttgaatcctgttttaaacagctttataatcaatgggaaatgaaaaatgaaaacagggtagaagttgataaattagggtttgcttcagtaaggatggataattggtttggggatttaactttcaatgttgtagcaagaattgttgctggaaaaaagaattttgcaggaggtgcagtaaatggtgatattggagctcagagatataaagtagccatggatgaatcttttagattaatgctaacatttgcatattcagatgtgattccatcactgaaatggttagacaaattaagaggtttaattagagatatgaagcgttgtggatctgaaattgattcaattgttgctagttgggtagaagaacatcgtttaaagagaaattcttctgaaaataataatttagatcttgaagaagattttattgatgtttgtttggatattatagagagttcttcattacctggtgatgatccggatactgtcatcaaatctacttgtctggatatgatattgggtgggagtgataccacgacagtaaccctaacatgggccatctccttaatattgaacaatcctcacgtgttgaaaagggcaaaagaggaattaaattccgtagttggaaaagatcgacgtgtagaagattcagacatccctcatcttacatacatccatgcaatcatcaaagaaaccatgagactctaccctgctggaccactgatcgaaaggaggacaatggaagattgtgaagtaggtgggtaccacgttccagctggcacacgtttattggttaatgtatggaagatgcaaagagacggggatgtgtataaagacgatccattggtgtttagacccgagagattcatgactagtaatgctgatgtggatctaaagggtcagcattttgaactgataccattcggtgcgggtcgcaggatatgcccgggtgtgtcatttgcggttcagttgatgcatttggtattggctcgtcttctacatgagtttgaaattactacaataccttctgaaccaaaggtagatatgtctgaaagtggaggattaatctgtcataagataaagccactagaagtgctaatcaaaccccgactcgagctgaactaa

SEQ ID NO: 117 - DNA, 1614 bp, Argemone mexicana
atggatttctcatcaatactactacttctcaatattaattgcttcacaacttccttggtcacccttcttgttcttgtcatggtttttctctacaataatacaagatttactaaacccaaaggtaataaaaagatgattaaaccacccagactacccggtgcacgccctcttttaggtcacctccatctgtttggaccaggtgagcttcctcacaaggttctctcaaccatggcagataaatacggtcctgcctttacaattaagttcggtaaacacacaacattagttgtgagcgatatccataccataaaagaatgtttaactactaatgacatcctcttttctaaccgtccttcttctatagcctttgatctcatgacttacgctgatgactccgtagctttcgcacattatagtccttattggcgtgagcttagaaagatatctactctcaaacttctatctaataaccgtcttcaatctatcaaacaacttcgactctctgaggtgaacgtatgttttaaagaactatatagtttatgcaacaataataataaaagtggagctccggttttgattgatatgaagaaatggttcaaagaggtcacgactaatatagtcattagagttattgttggtaaacaaaattttgggtctaagattgtgcgaggcgaagatcaagaagctgccaattacaagaaaatcatggatgaactttcacgccttgctaaattgtctatgttctctgattatgctcctttacttagtttgtttgattacttccgaggaaacgtgagtgctatgaaaagaaatggtaaagaattaaacgcgatgcttcagaattggttggaagagcataagaggaagaagaactcatcaatatcgaacgatgatgaacaagatttcatggatcttatgttgtcaattattgacgaaactaagctatacggacgtgacgctgatactttcattaaagctatttccctttctatgatcgtgggtggaatagacaccgttgtcgtgactctaacatggattctcgccttaattatgaagaatccttttgctttgaaaaaggctcaagaagagttagactttttcgtcggaaaggaaagacaagtagaagattcagatctcaagaacttggtatacatgaatgccatcgttaaagaaacgctgcgattatacccattaagttgtattcttgaacgtgatacgaaggaagactgtgaagttggtggctactacgtcgaaggtggcacacgtttactaataaacgcatggaagttacaacgggacccgaatgtatggacagacccttcggaatttaagccggagagatttctaaatgagaatgcagacatagatgttggtggccaacattacgaattaataccatttggagctggtagaagagtgtgtcctggtgtatcttttgcactccagtttatggatttggttctggctcgtctcatccatgggtatgaattgggaactctaaatggtgaagatgttgacctaactgaaaaaactgaaggacaaattaatttcaaagcaacccctctggatctcatcgttactcctcgtctccaccccaatctttatgattattag

SEQ ID NO: 118 - DNA, 1569 bp, Berberis thunbergii
atggaatcaattgagtttctagtaactctgctactcagcctgcttgccctattttgtgcttatgcatggaagaggaaaaaccatacaaaggatagcaaaatcaaagagccaccccaaccagccggagcatggccgataatcggccaccttcatctaatatcccgcggcggccttcctcatataaacatgggggccatggcggacaagtacggtccagttttcatgatccggctaggagtaaatcgagctgtgattgtgagtaacacggagatcgtcaaagagtgcttcacaaccaacgataaattcctactaaaccgtccagttgggttagccttaaacctcatgtgctacaacaacgccatgttcgggttctgtcggtacggtccatattggcgagagatacacaaaatagtcatgcttgagctcctctcgaacagccggctcgagtccctgaagcacgtatgggactcggaaatatcgacatccatcgaagagttgtaccaattatgtcaaacacaaaacaagacccatgaaggcccagttttggttgaaatgaaggattggtttgcagatatggcactcaatgtgtcccttagaatgattgctgggaaaagatactttggtgcaagtgccggtggtaataaagatgaggcaagaaagtgtcaaaagaccataagagatttctttagacttgttggcttgtttatagtgtctgatgcacttccatttcttaggtggctagacttgggagggcatcagaaggagatgaagagaacatttgaagatcttgactatatgcttcaaggatggttggatgagcataaattgaatagaaaatctggtgtgaatggtgatcaagatttcatggatgtgatgttatctattcttgatgattcaaaatttccggattacgacgttgacaccgtcaacaaggctacgtgcttccaattgatcataggaggaactgatactacaacggtcactctaacatgggccctttccttgatgttaaaccacccacatgtattgaaaaaggcccaagatgagttggacatccaagtaggcaaacacagacaagtggaggaatcagacatcaagaacctaaaataccttgaagctgtgatcaaagaaaccttacggatgcgcccagtaggcccactgttaggcccacgagagacgatcgaggactgcaccattggtggatatcgagttcgagcaggcacacgtgtaatggtcaatgcttggaaggtgcatcgtgacccatcggtttggtcaaaccctgatgacttcaaaccggagaggtttctcaagaaggatattgacttcagggaccaaaactttgaattcatccctttcgggtccggtagaagggcctgccctggaatatcatttgccgtggaagtactgcccatggctttggcccgtttactacatgggtttgagcttaagactcaattgggttgcaaggtggatatgacagagcatgccggtttagttcatgctaaagctacccctttggaagttcttgtcagcccacgcctgtctcgagagttgtatgtatcgtcttag

SEQ ID NO: 119 - DNA, 1543 bp, Berberis thunbergii
gggatcacttgctctcattgccattattattctttccaacattgtcaaaaaatcttcgaaatctctttccagtaaaggtggcaagagtgcacccgtggttcatggtgcgtggccagtcatcggtcacctgcacctactgatgggtaaggagttgcctcatcatgcattagccaaactggctgataagtacgggccagccttcacactcaacattggcgcgtatcaagaactagtgatcagtactcgggatcttgcaaaagaatgtttcaccaccaaagacaagttcttcctaaatcgtccaagcaataaggccatgaagatcctgacatatggtgaagcatcagttgggttcgcaccatatagcccactttgggtcgaaatgcgcaaggttacgaaatctaatctcttatctcaccaaagggtcttgatgcaaaatcgttcacgagcatcagaaattgatgcaagttttaaacaactatatgaacaatgcaatgggaagagtggagcttcggtggaaatgaaaaactggtttgaagaagtgatgttgaatgtggttactaggaatgtttctgggaaaagaagttttggtaccaaggcaagacttggtgatgcagaggccgtgaagtataaaagggttattgatgagaccgcacggtttatggggaaccttgtgatctcagatatggttccaagtctttggtggttggataacatgttgggtgctgagagtgctatgaagaaacttgccatagaattggattctctacttggtggttgggtggaggaacatagagggaagaagttgagtgacgacgaggagggggactttatcagtcttacatgggagatgatcgatcagattcagcttcatggtcttgcccctgagacgttcatcaagtctatgtgtgtcggcgtgctgttgggtgggagtgataccacatcagtagccctaacatgggcactctcgctaatgttgaacaatcgcgaggtgttgaagaaggcccaagaagaattggacttccacgtaggaaaggaccgcaaagtggacgactcggacctcaagaatcttgtttacttacaagccattatgaaggaaacaatgaggatataccaagtaggtcctctaattgaacgagaggccgttgaggactgtgaagtgggtggattccaaatcaagaaggggaaccgtatactagtgaacctgtggaagttgcaacgtgaccctgaagtgtggtcagatccgtccgaatttcgacctgaaagatttcttgaggataagtctaaggtggacttgaagggccaaaatgctgaactaatgccgtttggcagtggtcgacgtatgtgtccaggagtttggtttggggtgcactccacttctttggtacttgctcgtctcatccaagggtttgaaatagagacaccactggatgcaaaagttgacatgacggagacatcaagtgtgaccaattataagggaagtcctcttgaagttattgctcgactccccggctcgaacctaagctttatgatttgtagttatgta

SEQ ID NO: 120 - DNA, 1638 bp, Corydalis chelantifolia
atgactccctcaatttcacaaccttttgagcttcttcttcttctgatgacaatggagtctcttcttctccaatggcaaccaacttccattgctgttcttcttctcgccatcacaattttcctctacaccttcacaaaatcaccccctaaaacccacaaaaaactagccccagacgcaacaggaggacggccattaatgggtcatcttcatctcttcaattcaaacgaattaacacatcgaactctaggatccatggctgataaatatggtccagctttcaacattcgattcggttcacacaaaaccctagttgtatctacttgggaaatcgtcaaagaatgtttcaccaccaacgatcgatcattctcaaatcgcccaggaactctatacatcaaactcatgttctataacgaagattcagtagggtatgcaccttatggagcttactggagagatcttcgtaagctatcaacactgaaactactctcaaaccatcgattggaatcattgaaacatttgagggtttctgaaatgaatgaatgtttcaaacagctttatgagatttgtaacaaaggaagtaaatctgttgctgttagaatggataattggtttggtgatttgacttttaatgttgttgcaaggattgttgcagggaaaaggaattttgcttcaattagtaatgatgttggagctatgagatataagaatgcaatggatgaagcttttagattgatgactgttttttcattttctgatgtgattccatcacttggttggttggataatttgagaggattagtgggtgatatgaaaaaagctgggaaagaaattgattcagtggtttcaggttggattgaagaacatcgtgagaagagaaagagaagatcatctggtggtaataacagagatggagaattagaagaggaggatttcattgatattactttgtctatcttggaaacttcaagtctccctggtgatgatcctgacatgactatcaaatctacttgcttggatatgatcttgggtggtagcgacactacaacggtgactatgacttgggctctctccttgctattaaacaatgctcacgctttgaaaagagcaagagaagaactggacttgcacgtcgggagagatagacaagtggaagattcagatatcaacaatttggtctacatccaagcaatcatcaaagaaacaatgagactatacccagctggacccctcattgaacggatgacaaaggaagattgtgaggtaggtggattccacatcccagccggaacacgtttgttagttaatctctggaagatgcaacgagacccaaatgtgtgggaggatcctttggaatttcgacctgaaagattccttaccaacaatgcagaaatagatctaaagggtcagcatttcgaactcatcccatttgggacgggtagaaggatatgcccaggtgtttcatttgccttacaattgatgcatttggctctcgctcgtttacttcacagttttgaagttgcatcccccatggatgccaagattgatatgactgaaaccgcaggccttataagccacaaggtaattccgctagaagtcctcatgactccacgccttgactctaagctttatgattattag

SEQ ID NO: 121 - DNA, 1572 bp, Corydalis chelantifolia
acacacacaaccgaaaagaatttaccaccggaagtgcctggtgcattgcctgtcatcggtcacctccacaagttaggtggtcggaaaggtcttctaccatatcatgttcttggagccatggctgataagtacggacctgccttcacattccagtttggttctaaccgaacccttgtgattagtaattgggaaatggtaaaagaatgtttcacgtctaccaacgataagttattcgcttatcgtccaacagcattgttcaataaggaagtattctgtagtgaccattcttttggattcggaccttatggcccgttctggagggagatgcgtaaggtttgttcgcttcatcttctctccaattatcgcctcgagctcttaaaacactctcgaaaatccgagatggatgagtgtttcaaggagttgtaccaactatggagtgcttcaaatattagcaaagacaagcaacctgctgttttggtggtggaaatgaagaaatggttcgaagatgcgatgttcaatgttgcttcgagagttgtggtgggaaaaggaagtttgaaatctcatgagaaggctggagggagtgataatgaagtagcgaggaacaaatataagaaaggcatggatgaggctagacgacatatgggaacatttgttatatcggataggatcccgtttctttggtggattgattatttacggggtatccatagttctatgaagcgaacggcgaaagaccttcatgccattgtagagacgtggttagaggaacaccgtcttcattgtcacaaacggagagtattgcaactcgatgccaaccatgaggttgaagatatggcgaaagaggaagaaaaagattttatggatgttttattgacgatggcggacgagggagccatcaaaatctttgaccatgatcttgataccgttatcaaagctaattgtctggatatggttatcgctggaaccgatacaccaaccgtaatgcttacatggaccctttcactattactaaacaatccagatgttttgaaaagagttcgagatgaactggatttacatgttggaaaagaaagacaagtagaagaatctgatgtcaagaatttggtctatctccaagcagttttcaaagaaaccctgcgtttatacccagctgtacctctaaatgaacgtttgacaatggaggattgcaatgttgggggttacgatatcccagccggtacccgtctattaatcaacatttggaaggttcaaagagacccaaatgtgtggcaggatccctcagaattccgtcctgaaagattcttgagtaaggaaaaatccaccatagatgtgaggggtctagattttgaactcattccattcgggacaggtagacggatgtgcccagggatttcattttccctccagctcatgcatttgggactcgctcgcctcattcacggctttgaattagcaactccgatggatttggatgtcgacatgtctgcaaatcctggagctttcaactataaatcaaccgatcttcaagttcttgttagcccacggtttcattctaagttctacggttgttaa

SEQ ID NO: 122 - DNA, 1611 bp, Corydalis chelantifolia
atggatttccttgctcttcaatggttcccagcttccttgactgcccttcttgccttggctgtcctttacaacttctggaccaagcaaaggacttacaagaatggaaagacgagtactaaacaggcacctgtagctgccggtgcatggccagttcttggtcaccttcacttgtttggtggaggtgaactgcctcacaagatgcttgctactatggctgataaatatggacctgccttcacaatgaagtttggtacacatcaaacactagtagtcagtaacaccaagattgtaaaagaatgtttcacaaccaatgatactttgtttgcaaaccgtccatccaccacagcctttcacctcatgacctacgataacgagtcggtagccttcacaccatatggtccattctggcgtgagctgagaaaaatctcaacactcaagcttctttctaaccaccgtctccaagcaattaaggatgtacgtgcctcggaagtgaatgtgtgcttcagggagttgtacagtcaatggaggataaataaaagcgagcctgaaaccagtgatcatcagggtccaattctggttgatatgaagaagtggttcgaagaagtctcagacaatgtggtgcttagagtgattgcagggaaacaaaactttggctctaagattgtgcatggagacaaagaggcccttcactacaagaaaatcatggacgagatactacgtcttgcggcagtttccatgctttcagatgtggctcctttgcttggttggttagatatgttccaagggcatttaagtgccatgaaacgaaatgcgaaagaggtagatactatgctatgtaactggttggaggagcatcgaacgaaaagactctccagcgatcatgacggtgtagagcaggatttcatagatgtcatgctgtcaatcgtggaggagaacaagttctctggccacgacaatgataccgtaatcaaagctactgtcttggccatgatcatgggtgggactgataccaccgctgtcagcttaacttggattgtgtccttgttgatgaacaaccgccacgttttgagaagggcacaagatgaacttgacttgcacgtggggaaggatagacaagttgatgattcagatctcaagaacttggtttatctcaatgctatagtcaaggaaaccatgcgtttgtacccattaggtgctcttcttgaacgtgaaaccaaggaggattgtgaggttggtggtttccatgtcaaaggtggaacacgcctattagtgaatgtatggaagctacaacgagacccaagcttttggaccgatccaacagaatttaaacctgaaagatttttagcagacaaggcgaacatagatgtcggtggtcagcattttgaactactgccatttggggctggtagaagagtgtgcccaggagtctcgttcgcactgcaattcatgcatttggtacttgctcgtctacttcacggatttgatttggctacccctatgaatgcagatgtcgatctaaccgagagtactgaaggacatgtcaaccagaaagcatcccctctcaatctacttgtcactccacgtctccattctaagctttatgaatactag

SEQ ID NO: 123 - DNA, 1632 bp, Corydalis chelantifolia
atggagtacacattctcatcagcctcattgttctcctcctcctcccttcaacaatggctctcaacccttctacttctaatttcctccatcaccatttctctttaccttactcgtcgcggtaagtcatcaccgccaatggtccctggagcatggccactcattggtcacctacatttacttggtgggaacgatccacttcatatcgttcttggaaccatggctgataagtatggacatacctttgccatgttattcggtaaacatccatcacttgttgttagtagtagtgacattgtaaaggaatgtttcacttctacaaacgataaattgttttcgcatcgtcatgttcctaccggagttaaatacatgttctacaataatgactcgtttggttttgcaccttacgggccttattggcgtgaaatgcgtaaaatgaattcactttctcttttctcacaccatcgcgttgaaatgcttaaccgaattcgaacatctcaaattaacatttggtttaaaaacctatatgaaatgtgtaccaaggagaagagtactagtacaagtagtgatggagttgtggttgaaatgaagtcatggtttgatgaaatgtttttcaatgtacttgtgaatatgattgttaaacctattaatgatgatgaagagttggtgaagaaatacagagaagtggcgaccgaggcaggacgcctattgtcaagcatggctgtttcggatatggttccatctctaggatggttggatcatttgtttgggattgtgggtaaaatgaagaaaactgcaaaagatatggatgctatcctcactacttggttagaacagcataagatcaaatctcaacagctgaggagaagtaatggaggagaaggtgctgctgatcaaacagaggaggaggagaaggagggaaaagggctcattggtgatttgttgtctatgcaagagtctgctcttttcggccatgaccgagacactgtcatcaaatctgcttgccaggcgttgatcatggctgggagtgacagtacatcagccacattaacatgggttctctctttgttactgaaccatcgtgacgcactcagaaaggctcgagaagaactggatcaagttgtaggaaaggacagacaagtagatgattcagacattaaggatcttgtatatctccaagccattttaaaggaaacgatgcggttatatccagctgcaccgatattagagcgcttggcagtagaggactgcattgtaggtggatttcatgttcaagcaggcacaacactgtttgtgaatgtcagcaagctgcaacgtgacccaaatttatggacggatcctttagaatttaaacccgagagatttctcaccggctgtaacgcggatgtggacttgaagggtcaagattacgagctcgtgccttttggttcgggtagacggtcatgtcccgcggtatcgtttgcagttcgtgtaatgcttttggtacttgcacgcttcattcactcatttgaagtgaagactcgtgaagaagatgggattttggatatgactgagagttcaggtcacaccaattgcaggtctagcccactggaagtcctcatctcaccacggttggattcgaagatctactgttga

SEQ ID NO: 124 - DNA, 1587 bp, Corydalis chelantifolia
atggagtactactcatcactaccatttcttcaacaatggccactttcatctatatcatcatcaccaacttctattgctacaacacttctcattgtagcttgtttcaccattgttttcctctacataaacaccagttctaagtccaataacaacctgaaatcaccaccgaaacttcccggtgcatggccattcatgggtcacctacatttactaggtggaaaccaaccagctcatgtcagtcttgcaaacatagcagagaagtacaaatcgactcccttcatgatccgaatgggtcaacattcaaccctcgttgttagttcggttgatctcgtaaaggaatgtttcaacaatacaaatgataagctgttttcgaatcgtagtatcgcaagaggaattagagatatgttttacgatatggaatcgtttgggtttgcaccttatggttattactggcgtgaactacgaaaagtatctgcccttactctgttctctactcatcgtgttgattcggttatccaaattaaaacacctcaaatcgacggttggtttaagaaactttacgagcaatgtacgaatacgaaaggcggaattgttgaaataaaatcatggttggatgaaatgatgtttgatgttcttgtgaagatgcttgttgaacctaaggatgaaggatctgtggagaaatacagacatgtagcaggggaggctttggaagtgctggggaatatgagcatctatgatttagtacctagtcttggttggttggatcacttcactgggcttgtgaagaaatataaggtaactggtaagaaaatggacactatcctcaacagttggttagaagaccatcgaggtgagaaagtagctgaggaacacaagggtttaattggtaagttgttgtcaatgaaggaaggatcaaagcttcttggccatgatggagatactgccatcaaatctactgttcaggtgttgatcctaggtgccggcgatagtgcaggagcaactttaacatgggcaatctcattattattgaaccatcctcacataatggagaagcttcggaaagaactggatgcagccgtaggaaaggatagacaaatcgaagactcggatgtgaaaaaattcacttatctactagccatattaaaagaaacaatgcgattatacccggtgacaacgcttctacaacgggaaacgatggaagattgtgctataggtggatatcatgttgctgctggcacaagactgatggtaaatgtttggcaggtgcaacgtgacccgaatgcgtggtcagatcctttggagtttaagcctgagagattcctaactgagtgcgcgcatgtggatttctcgggtcagtattctgagcttattccattcggaacaggtcgacggatatgcccagctcttacgctatcggttcggctcatgttattgacccttgcccgtattatccattcgtttgatgtgaaaattcctaatggggcatcgagtgtggatatggcaacaagcgtaggttttgttaatctgaggttgaccccacttgaagtcgaactctcaccacgcttggattcaaagatctacggttga

SEQ ID NO: 125 - DNA, 1614 bp, Corydalis chelantifolia
atggattcctctcttcttcaatggtacacaacagcttcaatggctgcccttcttgccttagctttcttctacaaactctggagtaagccaaggacttctaaaaatggaaaaagtactttgcaggcaccagtagcagctggtgcatggccagttcttggtcaccttcatctgtttagtggaggtgagttaccacacaaaatgttggctgccatggccgacaagtacggccctgccttcacaatgaagttcggtacacaccgaacccttgtggttagtgacacaaagattgtaaaggaatgtttcactaccaatgatacgttatttgctaaccgtccatccaccatggcctttcatctcatgacctatgacaatgagtcggtagccttcacaccatatggtcaattttggcgtgagttgagaaagatctccacactcaaacttctttctaaccatcgccttcaggcaatcaaagatgtacgtgcctcagaggtgaatttttgctttaggacgttgtacaaccaatggaggataaataaaagtgagactatcggaaccggtgatcatcaaggaccaattttggtggatatgaagaagtggttcgaagaagtgtcaaacaatgtggtgatcagagtaattgtaggcaaacataactttggatctaagatcgcccgcggaaagggagaagcccttcactacaagaaagtcatggacgaggtcctacgtctagcggcagtgtccatgctctcggatgtggcccctttacttggttggttcgatcatttgcaagggcatgtaagtgcaatgaaacgaaatgcaaaagaagtagacactttgctctgtagttggatggaggaacatcgaaaaaagagaacctccaacggcagtaatggtgtagagcaagatttcattgatgtcatgctgtccatcgtggaggagaacaagttctctgggcatgacagtgacactgtcatcaaagctaccgtcttggccatgatcatgggtgggactgatacatcagccgtgagcttaacttggattgtctccctgttgatgaacaatcgccacgttttgagacgggcacaagaagaacttgacacacatgtgggaaaggatagacaagttgatgattcagatctcaagaacttggtttatctcaatgctatcgtcaaggaaacaatgcgtttgtacccactaggcgcccttcttgaacgggaaactaaggaggactgtgaggttggcgggttccatgttaaggctggcacacgtctattggtgaatgtatggaagctacaacgagacccaaacttttggattgatccaacagaatttaaaccagagagatttttaactgacaacgcaaacatagatgttgggggtcagcattttgaactgctaccatttggtgccggtagaagagtgtgccccggagtctcattcgcattgcagttcatgcatttggttcttgctcggctaattcatgggttcgaattggatacccctatgaatgcaaatgtcgatatgaccgaaagtacagaagggcatgtcaaccataaagcatccgctctcgatctccttatcacaccacgcctccggtctacactttatgattattaa

SEQ ID NO: 126 - DNA, 1716 bp, Corydalis chelantifolia
atgttcaagtctgttccaagtgcacaggcaattttacwyaarctttcattcatccaccagtacttcctgctctctcaaacaaatatggattcccttctttttcaatggtttccagcttcaatggctgcccttgttgcctttgcttttctttataagctttggagtgcacccaaaattaccaaaaatggaaagacaagtactaaacaggcacccatagcagccggtgcatggcctgttcttggtcacctccatcttttcggtggaggtgaattgcctcacaaaatgcttgcaggcatggctgaaaaatatggtcctgccttcacaatgaaatttggtatgcatcgcacactcgtggtcagtgataccaagatcgtaaaggaatgtttcactacccacgatactctctttgctaaccgtccatctaccacagcttttcaccttatgacctacgatcaagagtcggtggccttcaccccttatggtcctttctggcgtgaactacgaaagatctccacgctcaaattactttctaaccaccggttacaagcaatcaaggacgttcgaacctctgaagtaaacgtttgctttagagggttatacaacatatggcaaaccaacaaaaatgagcaaggtggtactgttagtgatcatccacgccccgttttgattgatatgaagaaatggttcgaagaagtttcgaataatgtggtgattagggtgattgccggtaaacaaaactttgggtctaaaattgtacgtggtgaagaggaggcagtaaaatacaagaaaatcatggatgaagtcctacgccttgcggcagtatctatgctttctgatgtagctcctttacttggttggttagatcttttccaagggaacttgagtgcaatgaaaagaaacgcaaaagaagtagataatatgcttaatgcttgggtggaggagcatcgaagaaagaggctcgcacatagtgctaaagttgaggctactcatgtagaacaagactttgttgatgttatgttgtccatcatggaggagaacaagctttcatcagtccacgacgatgacactgtcatcaaagccactgtgttggccatgatcatgggtgggactgataccacagctgtgagcctgacctggacagtttccttgttaatgaaccatcgttatgtgttgaagaaggctcaagaagaaatcgatcaacatgtgggaaaagaaagacaagttgaagattcagatcttaagaacttggtttatcttaatgccattgtcaaagaaactatgcgtatgtacccgttgggtgctcttcttgaacgtgaaaccaaggaggattgtgaagttggtgggttccatgtcaaaggtggaacacgtctattggtgaatgtttggaagttacaacgggatccaaatgtttggattgatccaacagaatttaagccagagagatttttggcagagaatgccaacatagatgttgggggtcagcattttgaactgctaccatttggtgctggcagaagggtgtgccctggagtttcattcgcactccaattcatgcatttggttcttgctcgcttaattcatggatttgaattggaaaccccaatgaatgccgatgtcgatctaactgaaagtaccgaaggccatgtcaaccacaaagctagccctctcgatctgctcatcgccccacgactcaactcgaagctttatgaattgtag

SEQ ID NO: 127 - DNA, 1602 bp, Corydalis chelantifolia
atggattccttgtttgttcttcttcaatggttctcagcttcattggctgcagttcttgctttggcttttctttataacctatgggttaagccaagaattagtgatggtaaaggaaataaagggagtactaaacaagcacctgttgcagccggtgcgtggcctgttctcggtcaccttcatctctttggtgggagtgaattacctcacaaaatgcttgcagccatggctgataagtatggacctgccttcacaatgaagttcggtacacatcgaacacttgtggtcagtaacacccaaatcgttaaggaatgttttactaccaacgatacacacttttccaaccgtccgtccaccacagcttttcacctcatgacttatgacaacgattcggtagctttcacaccttatggtccattttggcgtgagttgcgtaagatctctaccctcaagcttttatctaaccaccgtcttcaggcaattaaggatgtacgtgtttccgaggtgaatgtttgcttcaaggatctatacaatcaatggaagacgaatcaaaaccaacgtccggtcttggtggacatgaagaaatggtttgaagaagtatcaaacaatgtggtgattagagtaattgtggggaaacaaaactttgggtctaagattgtgcgcggtgaggaggaggctgtcaaatacaagaaaatcatggatgaaatcctacgccttgcggcagtgcctatgctttcggatatggcccctttacttggttggttggatcttttccaagctcacaagagtgcaatgaaacgcaatgcgaaagaagtagacaacatgcttgaaagctggctggaggagcataaaaggaaaagactatctggtgtaaatggtgcagaggaggaagatttcatggatgttatgttgtcaatcatggaagagaacaagttcactggacgtgatagcaatactgtagtcaaatctactgtcctagccatgatcatgggtggaaccgatactacagccgtgagcttaacttggattttctccttgttaatgaacaaccgtcatgcactgaaaaaggcacaagaagaattggatatgcacgtcgggaaagacagacaagttgaagattcagacctgaaaaacttagtttacctcaatgctatagtcaaggaaaccatgcgaatgtacccactaggtgcacttcttgaacgtgaaaccaaagaggattgtgaggtaggtggataccacgtccgcgcaggcacacggttgttggtgaatgtatggaaactacaacgagacccaagcttttggactgatcctacagaattcaaaccagagagatttttaaccgagaacgcaaagacagatgttggtggtcaacatttcgagctactaccatttggagcaggtagaagggtatgtccaggagtctcatttgcacttcaattcatgcatttggttattgctcgtttgattcacggttttgaattgggtactccaatggatgccgatgttgacttaaccgaaagtactgaagggcatgtcaaccacaaagcaactccactcgatctcctcattgccccacgcctcgactcaaaagtttatgattactaa

SEQ ID NO: 128 - DNA, 1593 bp, Chelidonium majus
atgaggagtaattacttaaagccgacgacgacgacgatcgaggataaaagtaagaacaagataagcaggaagaagccaatagcagcaaaaccaccacctgaagcattgggcgcatggccagtgatcggtcactttcttctatttacagggaaagggttgactcatgtgactctaggagacatggcggataaatacggaccagcatttcttattcggttcggtagccatagaacacttgtggtgagtagttgggagatgatgaaggagtgtttttcggcccctaacgataagatcttttcaaaccgtgaatccaacttattatggattaagtcaatgttctacggttccaattcatatgggttctcaccttatgggccatactggaaggagctacgcaagatatcgacccaaaagcttctctcccaccaccgacttgatgcgatgaagcacttgcagatggtagaagttgatgcctcatttaaacagatttacaatttatgcaacaaaaatggaggttcaccatcacctagtagtattaatactactgctctggtgaacatggacgaatggttgtcacacctgatgttcaacgtgatagcaagaatggtcagtggataccaatccgatgatgtcgggacaggtgctacgagtactggggaaagattcaaggtttccatggatgagacgatgcgtcttatggccattttcgctgtttcagatttggttccatggcttgcatgtgtggatcgattaagaggccttacgagaaaaatgaaccgttgtggtaaggatttggactcgataattgggagactaatcgaagagcatcgtcaaaagagacgattatgcagaaataataaaggatcaaaaaatgaagatggcggtcatgatgatgatcaagacttcattgacatttgcttgtcaattatggagcaatctcagcttcctggcgataaccctgaaattgccatcaaatccattgtgctagacatgatatttgctggaagtcacaccacgactctggcaatgacgtggaccctctccttattgttgaaccatcgccacatgttgaaaaaagccaaggaagaaatagatgcacacgtgggtaatgaaaggcaggtggatgactcagacatccataatcttgtgtacattcaagccatcatcaaagaatccatgcggttgtacccgcccagcccactgttcgaacggatgacaatggaggattgtgaggtaggtgggttccacattccagctggcacacgcttatttgtcaatgtatggaagatgcaacgagacccaactgtgtgggaggatccattagagtttcgacccgaaagattcttgacgagcaagagagagatagatgtgaaaggccagcattatgaactcataccgtttggtgcgggtaggcggatatgcccgggcgcgtcatttaccttgcaggtgttgcatttggtgcttgctcgccttatccatggcttcgaaatgacgacgcccatggatgtaaaagtggacatggcgtcaagtgcagggctattcagtaacaagatgacgcctttggaagtgctgatcacaccacgtacagcctag

SEQ ID NO: 129 - DNA, 1674 bp, Chelidonium majus
atgaagatattgcaggagtttcatcaactcaccatttccaatattgttcttcttctacttatttctttcatctttttctctcttagtgcatggttcattgagagtactaattattattacagtagtaagaagaagaagagcaaaaagacaccaccacctgaggcatcgggtgcatggccagtgataggacaccttcatcaatttaaaccggacgatttacctcatgaggctcttggagacatggcggataagtacggtcctgtttttattgttcgattcggtagttatagaaaacttgtggtgagtaattcggagatggttaaggagtgtttcacggccgcaaacgataggtccttttcgaaccgtccggccgtcttagggattaggatcatgctctataacaccataacgtatgcgttcgcaccttatggaccgtactggagggagttgcgtaggatatcgtcgcagaatctcctctctaaccatcgagttgatatggtaaagcacttgcatgtcgatgaagttaataccttgtttaaacaactttacgagttatgcaacaaaaatggaggtcgaccccctactggtactaatactagtactagtgctgctctagtgaacatggatgactggttgtcaaacataatgttcaacgtgatagcaagaattgtcaatggaaacaacaaatccattaataatgagaggacaggtgccataaatgagaaaagatacaaaacagctatggatgaggcgaggcgtcttgtggcaatttttgcagtttcagattcagttccatggcttggatggttggatcgagtgagaggccttataagaggaatgaacctttgtggaaaggaactagactcaattattgaagatataatcgacgagcatcgtcaaaagagacgattatgcacaagtaaattaggatcatcaggagatgatgatgctgataatagtaatcttgaggaagaagataacttcattgatgcgtgcttgtcgatcgaggagcaatcgcagttacctggcgaaaatcctgaaatcgtcatcaaagctttgatcctggacatgtttgctggtggaagtgatggcccacattttgtgttgacgtggaccctcgccttattattgaaccacccccacgtgttgaaaaaggcaagagaggaagttgatgcacacgtggcaaacgatagacacgtggatgtctctgatatctctaatctcgtctacatacaagcaatcctcaaagagtcaatgaggttgtacccgcccaacgcactcattgagcgaatgacaacagaagattgtgaggtaggtgggtaccacattccagctggcacatacctattggttaacgtatggaaggtacaaagggacccgaccgtgtggcaggatccctctgagtttcgacccgaaagattcttattaacaaacacaaaaacggagatggagtatgaacatataccgtttggtgcgggtaggcgaagatgcccaggaatgaggtttgcattgcaggtgatgcatttggtgcttgctcgacttattcatgaattcgaaatcacgacacccgtggatgtaataaaagtcgacatgacggcaactaatgggttattcaatcacaaggccgtgcctttggaagtgctactcacaccacgtactcttatccgaggttag

SEQ ID NO: 130 - DNA, 1626 bp, Chelidonium majus
atggattattcagtccttctccagtacggctggtttgctccttccatggctgcccttcttgccttagctttcctttacaatctctttttggcttcatctccgaaagctactagcaagagaacaataagtacaaagaaaccgcccatggcagccggtgcatggccaattcttggtcatctccatctgtttaaagagggtgagttgcctcaccaaatgcttaaatccatggctgacaagtatggtcccgccttcctcatgaagttcggccaacaccgatccctagttgtgagtgactaccgcatcgtaaaagaatgttttactactaatgatacccacttttgcaaccgtccatccactacagctttcgatgtcatgacttacgctaatgaatcggtagctttcacagaatacagtccttactggcgcgagcttagaaagatatccactctcaaacttctctctaacaaccgtctccaggccatcaagaacctccgagaagaggaggtgaatgttagcttcaaggggttgtatgattcatggaagaataagaacaacaagagtaccggcagtgttggtgatgaacgagctccggttttggtcgacatgaagaaatggtttgaagaggtgtcaaacaatgtggtgattagggtaatcgtgggcaaatgtaattttgggactaagatcgtgcaaggtgagaaggagggtgtagagtacaagacaatcatggatgagcttttacgacttgctagtttgtctttgttatccgattttgcccctatacttggtttgttggatttcttccaaggtcatgtccgtaccatgaaacgaaatggcaagaaactagacgtgttacttcagaggtggttggaggagcataagaggaagaagagcacaccagaggatgagcaagacttcatggacgttatgctgtcggttattgaggagagcaagctttctggctatgacgctgataccgtcattaaagctacttgtctggccatgatcatgggtggaacagacacatccgcagtgagtctaacatggatcgtctctttactgatgaacaatcgtcatgcactaaaaaaggctcgagaagaattggacgcgcaggtggggaaggatagacaagttgaagattcagatctaaagaacttggtttacttgaatgccatcgttaaggaaacaatgcgattatatccactaggtactcttcttgaacgcgaaaccaaggaggactgtgaggttggtgggtttcacctcgaaggtggtacacgtttactagtgaacgtatggatggtacaacgagacccaagcgtgtggactgatccgacaaagttcacaccagagaggtttcttacggagaaggcagacatagatgtttggggtgggaattttgaacttataccattcggagcgggtagaagggtgtgccccggagtgtcctttgcacttcaattcctaaatttggtactagctcgtctcattcatggatatgaattgggaactccagatgacgcggatgtggatctaacggagagcccagaaggacatctcaatcacaaagcatcacctctcgagcttctcctcaccccacgcctcagtaaccctaagctctatgattattag

SEQ ID NO: 131 - DNA, 1614 bp, Chelidonium majus
atggagtttctctctctagaaccccaactaatttccatttttgttcttcttcttgcttcatccatattcctctacaatctcttgaagaatcatggaaggaaatccaagacctcaaaaccaccagcacctgtagcatcaggtggatggccaatcatgggtcatctccatcttttcaatggaagcgagttaactcatcaaactctaggttccatggctgacaaatatggtccagctttcaatatccaactcggttctcatcaaacactcgttgtgagtagttgggagattgttaaagaatgtttcactacaaacgaccgattcttttcgaatcggcctggatcgttagcgattaaactcatgttctacgacgctgattcagttggttacgcaccgtacggtgcttactggagagatcttagaaaaatctctacgttaaaactcctttcgaatcatcgagtggaaaccctaaaacatttgagaacttctgaagctgaatcatgttttaaacaactgtataatcagtggaagaacaacaaagttggcggcgacgacgatgaatttgctatagtgaggatggataattggtttggagacttgacatttaacgttgtggcgagaattgtcgccggaaaaaagaattttgctggaggtgcgacgagtggcgacgtcggagctaagagatataaggaagctatggatgaagcgttccggttaatgacgattttcgcgttctcagatgtggttccgtcgttaggatggttggataaattgagaggtttggttggagggatgaagcgttgtggtgcggaaattgattccattgttgggggttgggtggatgaacatagattgaagagagcttctagaaagggaggagatcataatgatctcgatcttgaacaagattttatagatgtttgcttggagattatggaacattctactttgcctggtgatgatcctgaaattgtcatcaaatctacttgtctggacatgattttgggtgggagtgacacaacaacggtgaccctaacatgggcactctccttactattgaacaatcctcacgtattgaaaagggctagggaggaattggacacacacgtcggaaaggacagacaagtagacgactccgatatgtctaatcttgtgtacatccaagcgatcatcaaagagacgatgagattgtacccagcaggaccactgatcgagcgaaggacatcggaggattgtgaggtcagtgggttccatgtaccggcgggcacacgcttaatggtgaacttatggaagatgcaacgagatgggagcgtgtataaggaggatccattggagtttagaccagagagattcttgactagcaatgctgatgttgacctaaagggacagaattatgaactgataccatttggtgcgggtaggaggatatgtcctggtgtgtcgttcgcagtgcagttgatgcatttggtgcttgctcgtcttgttcatggctttgaaatgaagacggccggaggtgcaaaggttgacatgacagaaagtgcaggactaattagccacaaggttacaccgctacaagtgctgctcaaaccacgccttgcgatccaacaagctttataa

SEQ ID NO: 132 - DNA, 1653 bp, Chelidonium majus
atggattcgatgaacctgtttcaacaagcgattgcagtaggtacccttgtcatcttcctctactatctatggaagtggacatcaataatattcactcgaactcaccaggcggcgccaccagaacctgccggagcatggcctattataggacacctccatctcctagcaggaggagcaaaccaactcgtatatcacatacttggatccatggctgacaagtacggcccaattttcacggtccgactcggcatgcgacgagccttaatagtgagcaactccgagttagcaaaagagtgtttcaccaccaacgacagaatcttttccactcgccctagttcagtagctataaaattgatgggctacgattcagccatgtttggcttcgcaccatacgggccttactggcgggagatgcgcaagatagcagtaactgagcttctctctaataggcgcctcgagatacttaaaaatattaggatctccgagatcaacatgtctataaaagatttatatcaactctgggttgagaataagaacagtggtgttgatggcggcggtgacggtggtgaggtggtggtgggatcaccggttttggtggagatgaagaggtggtttgaagatgtgtcgttcaacgtggtggttaggatggtagctgggaaaagatatttcgggagaagggttgaaagtgatgatcgtgaagaggaggaggcgaggaggtggcagaaggcgatgaatgattttatgcatttggtggggattttcgtggtgtcggatgccattccatttttagggtttttggatttccaaggatatgagaaggagatgaagaagacggcggttgagattgattatgttatgggaagatgggttgaggagcaccaacggcggaagctggagagggtggcggggggatctgatgatcaacaggaagatttcatagatgtgatgttgtcgatcttaaaagatggtgatcagttctatggttatgatcctgatacggttattaagtcttcatgcctgtctcttgttttaggtggtagcgacacaatatcagtaacactaacatggacggtctccttactgctaaacaatcgcaatgtgttagaaaaagctcaaagtgagttggacatccacgtaggcaggggaagacaagtggacgaatcagatatcaacaatcttaaatatctccaagccatcgtcaaagaaaccatgcgtttatacccagctggaccactatcagcaccaagagaggctatggaagactgcaccatagctggattccatgtccctaaaggcacacagttgatgctcaatctatggaaattgcatcgagaccctcgcgtttggtcggatcctttggagttcaaaccggagaggtttcttactactggcacccatggagatgttgatgttaaaggacaacatttcgaattattaccgtttggagctggtaggcggatatgcccagggatatcttacgcccttcaagtcttgcatttgacccttgctcgtcttcttcatagttttcatttatcaacgccatatgatatccccgtcgatatgactgaatcttctggactttcttgcccaaaagcaactcccttggatgtcctccttacacctcgtctcccttcagagctttatgtgtcttaa

SEQ ID NO: 133 - DNA, 1686 bp, Chelidonium majus
atggatttgttcatcttcttcagccggttccaatatattgtaggattattagctttcctgaccttcttctattatctatggcgggtttcaattacaggaacaaggatcaaaaccaaccaaaacatcatgaacggcaccaatatgatggcaccggaagctgccggtgcgtggcccatagttggtcatcttcctcagctagtaggccctcagccactcttcaagattcttggagacatggccgacaagtacggttcgatattcatggttcggttcgggatgcacccaaccttggttgtgagcagttgggaaatggcaaaggagtgcttcactaccaatgacaagttccttgctagtcgtccaactagtgctggaggcaagtacctcacctacgactttgctatgtttggcttctcattttatggcccctattggcgtgagatccgtaagatctccacgctcgaactactatcccatcgtcgcgttgagttgctcaaacatgtcccttacactgagatcggcggctctatcaaacaactttacaaactttggatggaaacacaaaaccaaaataagcaacgggatgatcatcaggtaaaggtcgacatgagccaagtgttcggatatctaacattgaatacagtgttaaagctagtggtaggaaagggtctattcaacaacaatgacatgaatcatgaacaggaagaaggtcgaaagctccacgagacagtacttgaattcttcaaactggcaggggtctcagttgcatcggatgctcttccattccttggctggctggatgtagatggacagaagagaagcatgaagaggatagccaaagaaatggatttaatcgctgaaagatggcttcaagagcatcgacagaaaagactaacatcaaacaacaaggctagcagcggccatgacgacttcatgagcgtgttgctatccatccttgacgacgattccaatttcttcaattacaatcgtgatactgtcattaaagccacctctctgaacctgatattagcagcttcagacactacatcagtgtccctgacttgggttctctcgttattagtcaccaaccccggtgccttgaaaaaggtccaagatgaactggatactaaggtgggcaggaacagacatgtcgaagaacgagacatcgagaaactggtctacctccaagccacagtcaaggaaactctacggatgtacccagctggtccactatcagtaccccacgaagctacccaagactgcaccgttggtgggtatcaggtaacagcaggcacacgtttggtggtgaacgtgtggaaattgcaacgcgacccgcgtgtgtggccaaacccatctgagttcaagccggagagatttctaccagacgggtgtgaggttggttgtggtgaagcagcaaatatggatttcagaggacaacattttgaatacataccatttgggtcaggaagaaggatgtgtccagggatcgactttgccatacagatcatacacatgacactggcctgcctactccatgcattcgagttccaggtgccctcatcactagataaacatcttgtacctgcagtaatcgacatgagcgaaggttcaggactcaccatgcccaaagtaaccccacttgaagtcctccttaacccacgcctacctcttccgctttatgagttataa

SEQ ID NO: 134 - DNA, 1569 bp, Cissampelos mucronata
atggaggccatgggtgaatattttcagcttatttcatggactgtgttttcggctttgatcaccatctactttatattcagtaggaagactaatggaaaaaagaaggcaccggaaccaggtggtgcatggccgattattggtcacctccatctttttggagctcatgacctgttgtaccgaaagcttggggccatggccgacaaactcggcccagtattcatgatccgttttggcatgcatcgagccgtcgtcgtaagtaactatgaagtagcaaaagaatgcttcactgtcaacgataagatactcgcaagtcgcccacggattattgcttcaaaactcatgggctacaaccatgcggccgttggattaagcccttatggcccttattggcgagaggcacgtaagatagccaccttggaacttctgtctaaccatcgactccaactactcaagcacatcaggatatcagagattgatatgtggataaaagagctaaaagaattttgtatgaaaagcagtagcgatggtccagttcttgttcaattagatggatggttcaatgctttgacacttaatataatggttaggaatatagccggcaagcgatattgtggcggtgctgaagcctttgaagatgaagagtcgcagcgatggaagaaagtttctagagaacttatgttcttgttcggagtctttatggtacccgatgcatttcctgtactggaaggcatagatgtgcagggtttcgagcgagccatgaaaagggttggtaaggaaatggatttcttcttgagtcgatggttggaagagcatagaaggaagaaaatagaactctccgagaaaggaaacgaagttaatgatcaaggagctcaagatttcatagacgtgatgctgaacacaatcaaggatgccaagatctttgagcatgacgctgatacgatgatcaaagccacttgtatggctctagttgtagcagggaacgacacgacaatgatcactctatcatgggcagtttcattgttgctgaataatcgtggagttttagagaaagcccaggaggaattgagcaaccagataggaaaaaacaggcatgttgaggaaggagacatcgagagcttgccttaccttcacgcaattgtgaaagagaccttccggctataccctgctgcaccactttcattaccacatgaagctatggaagattgcaccattgccggctttcatgttcctgcaggaacacgcttgattactaatatttggaagctgcataaagatcctaatatttggcctgacccattggagttcaagccagagagattcctcactactcatgcccatgtcgattttaaaggtcaacacttcgaattcatccctttcggatcaggaagaaggatgtgccctggatcgtcgctagcaatcagtgttttgcacctcacccttgcacgtttgctccatgaattcgagcttaaaactccggatgatgcaccggtggacatgaccgaaggtccgggtatcacactcatgagagcaaacccccttcacgtgctcattaatccaagacatgactga

SEQ ID NO: 135 - DNA, 1605 bp, Cissampelos mucronata
atgtcctcgcccatccaacaactactcctctccttgacctccattaatggcggaaccatcatctcagccgtcataatatcactccttctcatcctcacccttcatcgcctcctaaaacccattaattccaacaaaaccaaacaccctccaagagcatccggggcatggcccgtcatgggccacctccacaagctccgcgggccggacctcccccaccgcaccctctcatccatggccgaccagtacggcccaatcttcacaatcaatctgggccccaccaccgccctcgtcatcagcgacccagccgtcgcaaaagagtgcttcaccaccaacgacctcaccttctcctctcgaccgaccactctcgccaccactctcatgtgctacaacaacaccatgttcgggttcgccccgtacggcccgtactggcgcgaagtccgcaaggtcgtcatggcccaactcttatcaacccgtaggctcgagtcactcaaaaacatttgggcctcggagattgaccgctgggttaagggcctggcccaaaaggcccaaagtgggtcgcatggtgtggttgaggtggagatgggtgattggctggcgaggttgactatgaacattgggctaaggttggtcgtggggaagagttgtggtgagatggggagtgaggagtcggagaggtgcttgggtgctatgcgggagtatccggagttgctgggtcggttcgcgttggaggacgcgttgccgtggttgggtcggtttgatttgcaagggcatcagagggagatgaggagggctgcgagggtcttggatgagattcttgatgggtggttggatgagcataagcgaaatagatcggggttaagtggtggtgatgatcatagggatcaggattttatggatgtgatgttgtctgttcttgaacaagatcaagattcgagtcttagcgaccatgatgctgatatgatcaacaagtccacttgcctgaatctaatcttaggcatggctgataccacaatggtggccttaacatgggccatttctcttctcctcaacaacaaaacgtccctcaagaaggcccaagaagaattacaagcccaagttggcaatgaaagacacgtggacgaatctgatgtcaagaacctagtctacctccaatccatcataaaagaagtgttgaggctttacccaccagagccactatcgggcccacgagaggcccttgaagactgcgaggtggcaggataccatgtcccgcgaggcactcggcttatcgcgaatttgtggaagatccatcgtgactcgtccacgtggcaggattctatggagtttcgaccggaaaggtttctgacggcccacgaacacgtggatgtgtggggccagcacttcgagttcatgcctttcgggtcgggtcgaaggtcgtgtccgggagtctcgtttgaggttcgggtgttgccattgatactggctcgtttgatacacgcattcgagatgacgacacgtggagatgtgccggtggatatgagtgaaagaccgggccttgttatctcaaaagcaagcccacttgaagttatgatttctccgcgcttgccccttcacttgtttgaataa

SEQ ID NO: 136 - DNA, 1611 bp, Cissampelos mucronata
atggagtttcatttgcttctccaagcagttgcagcaactctagtgaccttcttcctttatgagctatgggctctaaggaagaagttcagcaggcttaccaaaactccctcatcaaaggctttgctcaaagcaaagtgcgcaccagagccgcccggtgcgtggccgatcatcggtcaccttcctttgctggtttcagccaagcagcctcatcgggcatttgctgcacttgctgagaagtatggtccagctttcatgctccgcatgggcatgagtcctatgctgattgtgagtaccaaagaggttgccaaagaatgttacaccgccaatgatcatgtgtttgctactaggcctgtcaccaccgctgggaagctcatggcttatgatcactcggtcatgggcttcactccttttggaacctactggagagaaatacgaaagatcgcgacggtggagctgttctcggctcgcaggatcgggatgttgaagccggtaagacagtctgaggtctcgttgtggatgaagggattgcatgagaagtgggtgcataatggaaatagctcggtctccgtggagctgaagagtcaactggaagaactcactttcaatttgcttacacaaatggttgccggaaagcgttactacggaagtaacgttgcaaaggtggatgagaagatggcggggctatttcgccacgccgtccaacaattcaattatcaccttgggaactcggagatgtatgatgccttgccattcatggcatggttggacttcaagggcgacgccaaggccatgaaaaagacacaaaaggacttggattttattatgcagacttggttggacgagcaccgcctaaaagcggatcaaatgcgcggggacgccatcaacaacaccagagacttcctcgacgtgctggtgatgatggagaagaccggccaattttcatcggcaattaaagacagagacactacaattaaggccttggctctgacccaactagtagccggagtggacagcatggccaacacaatggtgtgggtgttggctctcctaatgaacaacccagaaatgctagccaaagcacaagacgagctcgacaacaacgttggcaaagacagactcgtggaggagtcagatatccctaatttgaagtacttacaagccctcctaaaggagaccctccgaatgtaccccgtggggcctttgttggtgccgcacgaggcaacggaggattgccacgtggccgggtattttgttccacgtggaactggcctgttcatcaacgcttggaccatacaacgtgacccaaatgtatgggctgagccgaactgttttaatccagagaggttcttaaccactcatgcagagatggacgtgaagggtcaaaatcatgagctgttgccattcgggtcgggtaggcgatcgtgcccaggtgtgggactggccctccaagtgatgcacctcaccttggctcgaatattacaagcgtttgagttgaagactcaatcgggtgttggaattgacttggaagagtgctccggcatactgctttccatgatgcacccattgcaagtgatgatggcacctcgccttccttccgaactctatgattga

SEQ ID NO: 137 - DNA, 1575 bp, Eschscholzia californica
atggattccttaatccttaccaattggtttccaatatcaattgcttctgttttaaccctagttttcctttacaaagtcttactttcctcaagaactcttaaagataagaagattaagacttcacccatggcaaatggtgcatggccaattcttggtcatctccatctctttggttcaggtgaattacctcataaaatgctagctaccatggctgacaagtatggctcagccttcaggatgaagttcggtaaacacacaacactagttgtgagtgatacccgtatcgttaaagaatgtttcactaccaacgataccctcttctctaaccgtccttccactaaagcttttcaactcatgacttacgataatgagtcggttgcctttacaccttacggtccttactggcgtgagcttagaaagatatccactcttaaacttctatccaaccatcgtctccaagccatcaaggacgttagagcctcggaggtaaacgtatgcttcaaaagcttatacgatcagtgtaaaaatccaagtggagctcctattttgattgatatgaagaaatggttcgaagaggtgtcgaacaacgtggtgatgagggtaattgtggggagacaaaactttgggtctaagattgtgcaaggtgaggaggaagctatccattacaagaaggtcatggatgagctcttacgtctcgctagcttgtctatgttctcggattttgctcctttacttggtttcttggacatctttcaagggaacttgagtgccatgaaacaaaacgccaagaaggtagacgcaatccttgagaactggttggaagagcatcggaagaagaagaactcagttgctgaaagcgagcaagatttcatggatgttatgttgtcaattgccaacgagagcaagttgtctggtcacgatgccgatactgtcattaaagctacttgcctagcaatgattatgggtggaacagacactactgctgtaagtctaacatggatcatttctttattaatgaacaatcgccatgctttgaagaaagctcgagaagaattagatgcactagtaggaaaggacagacaagttgaagattcagatttaaagaatttagtatacatgaatgctatcgttaaggaaacgatgagaatgtacccgttaggtactcttctcgaacgcgatactaaggaggactgtgagatcggcgggttccatgtcaaaggtgggacgaggttgctagtgaatgtgtggaagttgcaacgagacccaaatgtatgggttgatccaacagaatttagacctgaaagatttctaaccgagaatgcggatatagatgttggaggtcagcattttgagttgctaccatttggagcaggacgaagggtgtgtcctggggtgtcgtttgcactacaatttatgcatttagtacttgctcgtctcatccatggatacgatttgaatactctaaacgaagaaaatgtggatctgacggagagcccagaaggacatgtgaaccacaaagcatcgcctcttgatctcatcctcacccctcgtctacattacaagttgtacgaatag

SEQ ID NO: 138 - DNA, 1599 bp, Eschscholzia californica
atggatactgcttcatcaatttcccttctcctcccttgggcagtagtagttccctccatagctacccttcttgctttgctacttttcctcttcatcacttcaccaaaaacacccaagaggaaaacaagttcaaaaccaccacccactgttcttccaggtgcctggccaattctaggtcatctccatctctttaaagaaggagaatcacctcaccacatgcttaagaacttagctgataaatatggacctgctttcgtcatgaaattcggacaacatcgttccctagttgtaagcaacactaaaattgttaaagaatgttttactactaatgacaccctcttttccaaccgtccatctactactgcctttgatctcatgacttatgctcatgactcggtagctttcacaccttatagtccttactggcgcgagctaagaaagatatcgaccctcaaacttctatctaacaaccgtctcaaagcaattaagaagctccgaggagaggaagtggacgtttgttttcgtgggttgtacggtttatggaagaataaaactaaaaatggtgctccagtcttggttgacatgaaaaaatggtttgaagaggttgcaaataatgtggtgattagagtgattgtggggaaacttagttttgggaccaagattgttgatggtgaagaagaagccgttgaatataaaacagtcatggatgaactcttacgtcttgctagtttgtctttgttatccgatatggctcctatactcggttggttggatttcttccaaggaagtgttcgtaaaatgaaacaaaccggtaaaagactagacgttttacttgagaaatggttgggggagcaccgagagaagaagaacttggttggggaagatgagcaagatttcatggatgtcatgttgtcgatcgtggaagaaagtaagctatctggccatgaagctgatgccgtaattaaagctacatgcttggccatgattatgggtggaacagacacaacagcagtaactctgacatggatcatctccttattgatgaacaatcgtcacgcactagaaaaagctagagaagagttggagacgcacgtcggaaaagatagacaagtggaagatacggatttgcagaacttggtctacttgagtgctattgttaaggaaacaatgcgattgtaccctttgggtactcttctcgaacgagaaactaaagaagactgcgaggttggagggttccacatccaaggtggaacgcgtttattggtgaatatatggatggtacaacgagaccccaccgtatggaatgacccgtcggcatttaaaccagagaggttcttaacagataaatcggaaatagatgttgggggtcaacatttcgaactgataccatttggggctggtagaagagtgtgtcctgccgtgtcgtttgctcttcaattcttgcatttggttctcgctcgactcatccatggatatgacttgggcactccaagcaacgtggaagtagacttgactgagagcctggaaggacacgttaatcataaagcatctcccctcgaactcctcctcactccacgcctcaacccgaagctttattaa

SEQ ID NO: 139 - DNA, 1647 bp, Eschscholzia californica
atggaatctgagatccaatatcaaactgcaacaatggcttccattcttagtactaatttgattctaagcagtatttttactgcttttcttctctatttcttactaaagatgagtccatttaggtcatcaaaaaacaagtcaagaaagcaagcaccaaaaccaactggttcatggcccattataggtcatctccttcatctccaaggaccaaaccttcctcacataaacttagcagctttggctgataagtatggatcagtgttcagcttccgtattggtctccgtccagccctcgttgtcagttcttgggagatagctaaagagtgtctaactacaaatgatagagtcttcgtctctcgcccgccgttaatagctatgaaacacatgggttatgaccacgccttgttcggattctccccttatggtccatactggcgcgaactccgtaaactagtgaaccaagaacttctttcgaacactaggattgagttgataaaacatgtttgggatactgaaataaatacattcattaatgacctttatgaagtttgggctatgaaaagtaatgaaggtgggggtgatgttgtggttgaaatgaagcaatgcttgtacgattttactctcaatctcacactaaaaatacttaccggaaaacggtatttcggtggtggtggcagcgaagagttaagagaagaagcaggaagatgtcaaaaagcagtaagaaactttcttaggttagtgggtacttttacagctcaagatgtcattccatttttggaaggttggttagacttgggtggtcatgagaaggagatgaaaattacaggaaaagaactcgactccctacttcaaaaatggttagaagaacataaagtaaagaaatcgtcagctggggaagaaggccaggagaatcgaggtggtgatgaagaagatttcatgggggtgatgcttacaaaacttcgtgatcacgagaagcttttaagttattacgatgctgatactatcaacaaggctacttgcttgactgtaatcctaggtgggagcgacaccacgatgatgactctagtatgggctctcgctttactagtaaatcatccgcatgtaatgaagaagctccaagatgagttggatacccacgtaagtaaagaaagacaggtggaagaatcagatatcaagaacctcgcgtatcttcagtctgttatgaaggaaacaatgcgtcgttacccagggacccctctatatgttagagaatcgatcgaggattgcactatagctgggtacgacgtcccaacaggaacccgtcttgtagtgaatgcgtggaagatccaacatgacccacaagtatggtctaacccattcgagttcaatccagagagattccttacaacccacaaggacatagatgttagaggtcagaatttcgaacttatcccatttggagcaggcaggagaatgtgccccggggcttcactcggtcttcaagtggtgcacctgactctggctcgtctagtacatggatttgagtttaaaacaccagatggcgaacccatggatatgacggagagtataggactaactaatcttaaagccactccacttgaaattatgctcactccgcgcctctcttccaaactatatgtgtgttga

SEQ ID NO: 140 - DNA, 1665 bp, Eschscholzia californica
atgggtctttcatttgatctttcttctcataactttcttcaattctcgaaccccactattctcattggcctctttggtttactagtttaccttttactagtaaatcttcgaaaacgaatatcacgaaaaaatgaggcacccgaagtggagggtgggtggcctatcataggtcatcttcatcatttcatgggtgggaaaaacaagctactccatgtagcatttggagcttgggctgataagtatggaccagtctatactctgaggatgggtctgaataaagtactagttgtgaatagtgcagaagtagcaaaagagtgttcaaccactaatgacatgctttttatggctcgtccatatcgaatagcctctgagatcatgggttatggatatgcgatgtttcctatcgctccttatggaccattctatctcaaaatgcgaaaaatggtcacccaagagcttctctcaaatagtagggttgattctctaaaacatgtgtggggttctgagataaaaaatgccattcaagaacttcacaagaaagtattatcaactaaaggtggtggtccaatttcaatggacatgaagggatgggtttccaatttaacgttccgaacggctatgaaggtgatttgtggtggtgttggtgttgatggtggtggtggtggtggtggtgctacttctcctgcaactagtattggagaacataattatgatgaagttggaagttttcaaaaagcattgaaagaattctttgttttactaggagaaattaggatttctgatgtgataccattcctagggtggttagatatgcgaacagggtacgtggaaaagatgaaggacaatggaaaatttctagacaatttaatggaggaaatgttggaagaacacaaaaggaagagaaggtcactaactgaagaagaggaaaaagatggaggttatgtggagcaagatttcatggacgtaatgatatcgaaacttaatgatccaaagcttctgtcctattatgacgctgatactatcaacaagtctacttgcctgactctaattttaagtgggagtgagacaacgatggttagtatagtttgggccttagcgttactagtcagtcatccacacgtgttaaagaaagcgcaagatgagttggatacgcttgttggtcgggaaagacaggtagacgaatctgatatcaaagatttggtatacctccaagctgtagttaaggaagcattgagactatttccaccggctccactttcaactccacgcgttgcaacagaggattgtgtcgtatcaggatatcatgtacctgcagggacccaactttttgtaaatacttggaagattcaacgtaacccggaagtatggcctgaaccatcagagtttagacctgagagatttttcacaacccacaaggatttcgacgttagaggtctacattatgacctccaccctttcgggtctggtagaagagcatgtccaggtgctggcttcgcccttcaagtggtgcatctaaccctagcttctctattacatgggttcgagattaaaaacccatcggatgaacccattgatatgactgagagtccaggagtaactaacttgaaagcaaccccactgaaagtcctcctgacccctcgcctcttctctaaagaagtttattaa

SEQ ID NO: 141 - DNA, 1686 bp, Eschscholzia californica
atggagaagcccatcctcctccagctccaacctggtattttaggcttattagctttgatgtgcttcttatattatgtaataaaggtttcattatctacaaggaactgtaaccagttggtgaggcatccgccggaagctgcaggttcatggcctatagttggtcatcttcctcaactagtaggctctggtaagcctctgtttagagttctcggagacatggctgacaagtttggaccaattttcatggtgcgatttggagtacacccaaccttggttgtgagcagttgggagatggcaaaggaatgcttcacctccaacgacaagttcctggctagtcgcccacctagtgctgctagcatttacatggcatacgaccacgctatgcttggcttctcctcttatggcccatattggcgtgagattcgtaaaatatcaaccctccacctactctcccatcggcgccttgagttgcttaagcacgtccctcacttagagatccacaattttatcaagggattgtacggaatttggaaagatcatcaaaaacagcagcagcagcctactgcgagagatgatcaagattcggttatgctggagatgagccaattatttgggtacttgaccttgaacatcgtattgagcttagttgtaggaaagagggtttgcaactaccacgctgatggtcatcttgatgatggggaagaagctggccaaggtcaaaagctccatcagacgataactgatttctttaaactgtcaggggtttcagtggcttcggatgctcttccgttcttaggcttgtttgatttggatggacaaaaaaagatcatgaagcgggtagccaaggagatggactttgttgcagaaagatggcttcaagataagaaatcgagtttgttgctgtctagcaaaagcaacaacaaacagaatgaggcaggggaaggcgatgtggacgatttcatggacgtattaatgtccacactcccagatgatgacgattcctttttcacgaagtatagtcgagatactgttattaaagccaactccctctctatggtcgtagcaggctcagacacgacatctgtttctttgacatgggctctttccttattactcaacaacatacaagtcctaagaaaggctcaagatgagctggacacgaaagtcggtagggacaggcatgtagaagagaaagacatcgataacttggtctatcttcaagctatcgtcaaggaaacactccgcatgtaccctgccggtccactttcagtaccacacgaagccattgaagactgtaatgttggcggataccacataaaaacaggaacccgtctgctggtgaacatatggaagttgcagcgcgacccacgagtgtggtcaaatccatctgagttcaggccagagagatttcttgacaaccaaagtaatggaacactgctggatttcaggggtcaacattttgagtacataccatttgggtctgggcggaggatgtgcccaggcgtgaaccttgcaaccccgattcttcatatgacactagcacgcttactacaatcattcgacttgaccacaccctcgtcatccccagtagacatgactgaaggttcaggattgacaatgcccaaagtaactccacttaaagtactactcaccccacgcctccctcttccactttatgattattag

SEQ ID NO: 142 - DNA, 1698 bp, Eschscholzia californica
atgaatttgtctagcaaattgatgggttcatttgatcttttctctcttaactttctccagttctcaaaacccgccagtatggttattattggcatttgtagttttctagtttacttttcactactaaatcttgtaaggcgagtactagcaccgtcttgtacgatgaaaaacggaaaaactgagccaccggaggtggaaaacgggtggcctattataggtcatcttcaccatttcatgggtaaaaagaataagctaatccatgaaatatttggagacatggctgataagtatggaccgacctttactttaaggatgggtctgactaaagttctagtagtgagtagtgccgaagtagcgaaagagtgtttaactacaaacgatttggtattcattggtcgtccacctcgtgtagccaattcactccttggttatagttttgccatgtttcctttttcgccttatggcacatactatagccaaatgcgaaaaatagtcacccatgagcttctctcaactagtagggttgagtctctaaaacatgtgtggaattctgagataaacaaagccattcaagaacttcatcacaaagtagtatcagttggaggtggtagtcctgttttaatagaatttaagcgttggttttcggatttaacgttaagaactactgttaagttgatctgtgggaagcagtactttggtacggatggtgctactcaggcgagtatgactattaatggaggaggagatgatgatgaagctgggaagtttcaagaggccttgagagagttcttttgtttactaggaaaatttagggtttctgatgtgataccatttttagggtggttagattttggaacaggttataaggaaaagaaaaatagaatgttcattgatagtttaatggaggaatggttggaagaacacaaaatgaagagaagattactaaatgaagcagataaaaaagaaagtcgtatagagcaagatttcatggatgtaatgatctcgaaacttgatgatcctaaccttctatcccattacgatgctgatactatcaacaaggctacttgcttgactttgattttagggggaagtgacacaacaatggttagtttggtttgggccttaacattgttaatgaatcatccacatgtgttgaaaaaggtccaagatgagcttgatttccacgtaggtcgtgagagacaggtcgaagaatctgatatgaaaaacttagtatatctccacgctgtaatgaaagaggcaatgagactaaatccagcaggtacgttatcggctccacgtatgtcaacaaaggactgcaccgtatccgggtaccacattcctgcaggaacccatctattcatgaatacttggaagattcaacgcgaccctaatgcatgggttgaaccaacagagttcagaccagagagatttctcactacccataaggatttcgatcttagagggcagaactttgaactcctccctttcgggtcgggtagaagatcatgtcttggtgctaactttgctcttcaagtgttgcgccagactctagctcgcttgttacatggattcgatctcaaaactccatcagatgagcccgtcgatatgactgggtctgctggactaattaatatgaaagccactccactcgaagttctagtcaccccacgcctcttctctagtgaattatatgggtaa

SEQ ID NO: 143 - DNA, 1853 bp, Eschscholzia californica
atgctcataaaacctctcgggagcaagataacatctcctcctccctccagtgtcaaagaaaaaagagaaatccgaagggtcgtcatgaggtatataagtgggcttaaacgatgcaaaatcagcaagataaagccaattccaagatgtaaccaaaacattctcgcatttaatatcaccatgacaaacaccaagtatcttccaatgaatttgctcatcttcttccaattcctcctccaattccaagttcttgtaggattatcagttttgctagccttctcctattacctatgggtttcaaaaaatcccaaaatcaacaaatttaagggtaagggtgccttattagcaccccaagctgccggggcatggcctattgttggtcatctccctcaactagtaggccccaagccgctcttcagaattcttggagccatggctgacaactatggacctatcttcatgctccgattcggggttcatccaactgtcgtcgtgagcagttgggagatgacaaaggaatgtttcactaccaacgataggcaccttgctagtcgtccatctaatgctgcttcccagtaccttatctacgaagtctatgctttgttcggcttctccttatatggtagctcatattggcgtgatgctcgtaagattgctacgctcgaactactctcccatcgtaggcttgagttgctcaagcatgtaccttatacggagatagatacatgtatcaaacaattgcacagactttggacaaaaaataacaaaaaccaaaacaaccctgagcttaaagtcgaaatgaaccaattttttactgatctaaccatgaatgtgatattgaagttggttgtaggaaagcggtttttcaacgttgacgatgcagcggatcatgaaaaagaagaagctcgaaaaatccaggggacaatatttgagttttttaaacttacggagggttcagtttcagcaggtgctcttccattactaaattggctggatctaaatggacagaagagagccatgaagagaacagccaagaagatggactccatagctgaaaaattgcttgacgagcaccgacaaaaaaggctatcaaaggaaggtgtgaaaggcactcatgatcataatgacttcatggacgtattattgtccattcttgatgctgatcaaggagattattcccatcatccattcaactacagtcgcgaccatgtcataaaagccaccactctgtcaatgatcctctcttccatgagcatatctgttagtctttcatgggcactctctttattactcaacaaccgccatgtcttaaaaaaggcgcaagatgagttagacatgaacgttggcaaggacagacaagttgaagagggagacatcaagaacctggtctatctccaagccattgtcaaggaaacattccgtatgtatcctgcaaatccacttcttctaccccatgaagctattgaagactgcaaaattggtgggtttaacgtaccagcaggcacacgtgtggtagtcaacgcatggaaactacaacacgacccacgcgtgtggtcgaacccatccgagtttaagccagagaggtttctcaatgaccaagcagcaaaggtagtagatgtgagaggtcaaaattttgagtacttaccatttgggtctggacgaagagtgtgtccaggaatctccttctccctccaaaccattcacatgtcactagctcgcctagttcaggcattcgagctaggaacgccctcgaatgagcgcatcgatatgactgagggttccggcttaaccatgcccaaaacaaccccgcttcatgtccttcttaacccacgtcttcctcttccactctatgaatg

SEQ ID NO: 144 - DNA, 1599 bp, Eschscholzia californica
atggagtttcattttcctctcatggaacaattccaaccatttttcatttttgcccttcttctagcctccttcatttttctctacaaactcttcaattttggaaacagaatcactaaaaatgggaaaccaacagctccggaagcatcaggaggaagactaattatgggtcatcttcatctattcaatggaactgagttaactcaccggacactcggttctatggctgataaatacggtccagctttcaatatccgattcggttcacataaaacacttgtagtgagtagttggaaaattattaaagaatgttttactacaaatgaccgattcttttcgaatcggcctggttctttagcaatcaaactcatgttttatgatgccgattcagttgggtatgcaccatatggatcgtactggagagaacttagaaaaatttcaaccttaaaactcctttcgaaccatcgtttagaaaccctaaaacatttgagaacttctgaagttgattcttgttttaatcaactaatgaattcttgggctgaaaacaaaaacaggggagactctgattttgctccggtgaggatggatgattggtttggggatttgacgtttaatgttgtagcaagaattgttgccggaaagaagaatttcgccggaggagcagcgagaggtgatgccggagctcagagatataaatcagccatggatgaagcttttagactgatgacaatatttgcttattcagatgtgattccatctcttgggtggttagataaattgagaggactagttggagatatgaaaagatgtgggtctgaaattgattcagtagttgagagttgggtggatgaacatagattgaaaagaagggtttctaagaaaggaggtgaattagatcttgaacaggatttcattgatgtttgtttggatatcatggaacattcttctttgcctggtgatgatcctgaaattgtcatcaaatctacttgcttggacatgatattgggtggaagtgacacaacaacagtaaccctgacatgggccctatccttgcttttgaaccatccccaagtcctgaaaagagccaaggaagaattagatagtcaagttggaaaggaaagacaagtagaagactctgacattcccaaccttcctctcatccaagctatcatcaaagaaacaatgagactgtatccagccggcccattgatcgaacgacgaactatggaagattgcgaggttgctgggttccacgtaccggctggcacacgtctattagtgaatctatggaagatgcagagagacaaggaagtgtggagtgaagaacctttagagtttagaccagagagattcctaacgagcaacacagaagttgatctcaaaggacaacattatgaactgataccatttggagcaggaagaaggatatgccctggtgtgtcctttgcggtgcagttgatgcatttggtgctcgcacgtcttcttcatgggttcgaaatgacaacaccaatgggtgagaaggttgatatgacagagagtgcaggattaattagtcacaaaatcacaccacttgaagttcttatcaaaccactcagggtctaa

SEQ ID NO: 145 - DNA, 1533 bp, Eschscholzia californica
atggattccttcttgcttgcttattgggttccaatttcagttgcttctattattgcttttgttttcctctacaatctcttttcttcaagaactcttcaaaataagaagattaggacagcacccatggcaacgggtgcttggccgattctcggtcatctccatctctttggttctggtgaattgcctcataaaatgctagctgccatggctgacaagtatggctcagccttcaggatgaagtttggtaaacacacaacactagttgtgagtgatacccgtatcgttaaagaatgtttcactaccaacgataccctcttctctaaccgtccttccactaaagcttttcaactcatgacttacgataatgagtcggttgcctttacaccttacggtycttactggcgtgagattagaaagatatccactcttaaacttctatccaaccatcgtctccaagccatcaaggacgtaagagcctcggaggtaaacgtctgcttcaaaaccttatacgaccagtgtaagaatccaagtggatcagctcctattttgatcgatatgaagaaatggttcgaagaggtgtcgaacaacgtggtgatgagggtaattgtggggagacaaaactttgggtctaagattgtgcaaggtgaggaggaagctatccattacaagaaggtcatggatgagctcttacgtctcgctagcttgtctatgttctcggattttgctcctttacttggtttcgtggacatctttcaaggaaacttgagtgccatgaaacgaaacgccaagaaggtagatgcaatcctggagaactggttggaagagcatcgcaagaagaagaactcagttgctgaaagccagcaagatttcatggatgttatgttgtcgattgttgaggagagcaagttgtctggtcacgatgctgatgccgtaattaaagctacttgtctagccatgatcatgggcggaacagataccacagcagtgagtctaacatggatcatttctttattaatgaataatcgtcacgctttgaagaaagctcgagaagagttagatgcactagtaggaaaggacagacaagttgaagattcggatttgaagaatttagtttacatgaatgctattgttaaggaaacaatgagaatgtacccattaggtactcttctcgaacgtgagactaaggaggattgtgagatcgacgggtttcatgtcaaaggtgggactaggttgctagtgaatgtgtggaagttgcaacgagacccaaatgtatgggttgatccaacagaatttagacccgaaagatttctaacggagaatgcagatatagatgttggaggtcagcattttgagttgctaccatttggagcaggacgaagggtgtgccctggggtgtcgtttgcactacaacttcatgcatttagtacttgctcgcctcatccatggatacgatttgaatactctaaacgaagaaaatgtggatctgacggagagcccagaaggacatgtgaaccacaaagcatcgcctcttga

SEQ ID NO: 146 - DNA, 1605 bp, Glaucium flavum
atggagtttctctctctacaacttcaaccagtttccatttttgctcttcttgttgcctccattttcctctacaatttcttaattcacggaaaaaaatccaacaacaagaagaccacaaaaccaccagcaccagaagcatcaggtggatggccaattatgggtcatctccatctcttcaatgaaaacgagttaactcaccgaacactcggttccatggctgacaaatacggtccagctttcaacatccgattcggttctcatcctacactcgttgttagcagttgggacatcgttaaagaatgtttcacaacaaacgaccgattcttctcgaatcggcctggttcgttagcgattaaactcatgttctacgatgccgattcagtcggttatgctccctatggtgcttattggagagacttgagaaaaatttcaactctgaagcttctttcgaatcatcgattggaaaccctaaaacatttgagaacttctgaagttgaatcctgttttaaagaactttataatcagtggaggaacaacaaaactggtggtggtggagatggttttgctccggtgaggatggataattggtttggtgatttgacgtttaatgttgtggcgagaattgttgccggaaaaaagaattttgccggtggtgcggcgagtggtgatgccggagctcagagatataaggaagctatggatgaagcgtttaggttgatgacgatttttgcgttttctgatgtggttcccgcgttggggtggttggataaattgagaggtttagttggaggaatgaagcgttgtggggcggaaattgattctatagttgcggggtgggttgatgaacatcggttgaagagaagctctggcaagggaagtgatgctgatcttgaacaggattttattgatgtttgtttggagattatggaacattccacattgcctggtgatgatcctgaagttgtcatcaagtctacttgcctggacatgattttgggtgggagtgacaccacaacagtgaccctaacatgggccctttccttactattgaacaatccccatgtgttgaaaagggctagggaggaattggatacaaatgttggaaaggatagacaagtagacgactcagatatccctaatcttgtatacatccaagcgatcatcaaagagactatgagattatacccagctggaccactgatcgagcggaggacatcagaggattgtgaggtaggtgggttccatgtaccagctggtacacgcttattggtaaacttatggaagatgcaaagggacgggagtgtgtataaggaggatcctttggagtttagcccggagagattcctgactagcaacgcagatgtagatttaaagggacagaattatgaattgataccatttggggcaggtaggaggatatgtccaggtgtgtcatttgcagtccaattgatgcatttggtgctggctcgcctcattcatggcttcgaaatgaagacgcctgaaggtggaaaggttgacatgacagaaagtgcaggactaattagtcacaaggtgacgcctttggaagttctgctcaaaccacgtctagcaatccaacattcatag

SEQ ID NO: 147 - DNA, 1686 bp, Glaucium flavum
atgcatgcgaaactgaccttgattaagaaaatggagttcaccatcatcaactctctagaaatccaaccaataatctccactttcgctcttcttactttctccattcttctctacaaaattctcttgaaccatggaagagaaaacaagaacaataaaccaaaaacatcatcatcatcatcatcaataccagaagtagcaggtgcatggccgataatgggtcatctccatctcttcaacggagacgagttaatgcaccataaactcggttccatggccgaaaaatatggtcaagctttctatatccgatttggttctcataaagcggttgtggttagcaattgggagatggttaaaacatgtttcactacaaataaccaaatcttcttaaataggcctcccatgttagctattaacctcttgtttttccccaccgattcgcttagttacataccgtatggtgaccactggagagagttgagaaaattttcaaaccaaaaacttctttccaatcaccgcatcgaaacccagaaaaatttgagaaaattagaagttgattactgttttaaacagctttgtaatcagtcttctaagtattttataattaacaacatggacgaccaagacagcaagtttgctctagtgaggatggatacttggtttgatgatgtgacattgaatgttctggcaagaattattgccgggaaaaagaagtttatatccggcggagcaacgagtagtggtgatgatgataatgctgaagctcggagatacatggaagctttagatgaaggacttcgtctgatgacgagtttcactttctccgatgtgcttccgtggttggggtggttggataatttgagaggtttggctggaaagatgaagcgttgtggtgcagaacttgattcggtttttgcggggtgggttgaagaacatcgtgtgaagagaggctctagaaaggatggtgatgatgctgatcttgaacaggattttattgatctttgctgggagagtttggaacaggtgcctggaaatgatcctgcaaaaatcatcaagttaatttgcatggaaatgattttgaacgggagtggcgccacggcagtgaccctaacatggaccgtctctttactattgaacaaccccgacgtgttaaaaagggcaagggaggagttggatacacacgtcggaagtcatcgacaagtggacgaatcagacatccctaatcttgtttacatccaagcaatcatcaaagagggaatgagattgtatccacctggaccattccttgagcgaagtacaactgaagattttgagatagatggggttcatgtaccagctgggactcggttatgggtgaacttatggaagatgcaccgagacgagagcatgtatcaggaaccactcgagtttaaaccagagaggttcttgaatagcaattcagatgtagatctaaagggacagagttaccaattgctaccatttggggcaggtaggaggatatgtcctggcgtgtcgtttgcgttgccgttgatgcatctgacattggctcgtctcattcatggcttcgaaatgaagttgcccgtaggtgttgaaaaggttgacatgacagaaaatggaggtataattaaccggaaggcgacacatttggatgtgctgctcaaaccgcgcctcatcgctcaacaagcttaa

SEQ ID NO: 148 - DNA, 1611 bp, Glaucium flavum
atggatacactttcaattcaatggattgtaccttccatagccacccttcttgccttagttttcctctacaatctcatttttacttccaaaaaaactaccaagactaacaacactaggaaggcaccaatggcatccggcgcatggccggttcttggccacctccatttatttggaaccggtgagctacctcacaaaatgcttgcaacaatggctgaaaactacggtaccgccttcacaatgaagttcggtaaccacactacactagtcgttagcgacactcgcatcgtaaaagaatgtttcactaccaacgacacccttttcgcgaaccgtccgtccaccaaagcattcgatctcatgacttatgccaatgactccgtagccttcacaccttatagcccgtattggcgtgagcttcgaaagatatcgactcttaaacttctctcgaaccatcgtctccaatcgattaaagacgttcgcgtcgcggaggtgaacgtatgttttagaggcttacacgttctatgcaagagtaaaatctatggagctccggttttagttgacatgaaaaaatggtttgaagaggtctcgaacaatatagtcatgagagtgatcgtggggaaacaaaattttgggtctaggattgtgcaaggacaagaggaggctgtctattacaagagtgtcatggacgagcttttacgtctagctagtgtatccgttttatcggattttgcaccgttatttggttggttggatttctttcaaggaaacataagtgctatgaaacgaaatgggaagaaactagatgtgatacttgagagatggatggaggagcatagacaaaagaagataagctcatcgtcgtcgatagccgcgtccggcgccggtgaagatgatgagcaagactttatggatgttatgttgtctatcattgaggagactaagttgtccggtcgcgacgccgataccgttattaaagctacttgcttggccatgatcatgggagggactgacactacagcggtaagcctaacatggatagtctccttattgatgaacaatcgacatgtactgaaaaaggctcgagaagaattggactcactagttggaaaggatagacaagtagaagattcagatttgaagaattttgtatacatgaatgctattgtcaaggaaacgatgcgattgtatccgtttggtgctttgctcgaacgcgacaccaaggaggactgtgaggttggtgggttccatgtcgaagccggcacccgtttactagtaaacgtatggaagttacaacgagaccctaatgtatggaaagatccattagagtttcgaccagaaagatttctggtcgagaacgtcgatatcgacgtcggcggtcaacatttcgaactattgccgttcggggccggtagaagggtgtgccccggcgtgtcgttcgcacttcagttcatgcatttggtactagctcgtctcatacatggatatgaattggaaacactaaatggtgaagatgtggatttaactgagagcacagaaggacatgttaaccataaagcatcccctcttgatctcctcatcacccctcgcctcgactctaaggtctacaattactag

SEQ ID NO: 149 - DNA, 1599 bp, Glaucium flavum
atggatagtacccttgttctccaatgttttgtaggttccatggcagctgtttctgccttggttttcctatacaatctcatatttagctcatcgaaaactaccaagggtaaggttcttaggaaggcacctatggcagccggggcatggccaattcttggtcacctccatttgtttgggtcaggtgagctgcctcacaaaatgttatccaagatggctgagaagtatggccctgcgtttacattgaagttcggtaagcacacgacactagttgtgagtgacacccgcgtcgtaaaagagtgtttcactaccaatgatacacttttcgctaaccggccttcgactaccgcatttgatctcatgacttatgccaatgactctgtagccttcacaccttatagtccttattggcgtgagcttagaaagatatctactctcaagcttctctctaaccaccgtctccaatcgattaaggaaatccgtgtctcggaggtgaacgtatgttttagggagctatttgagatgagcaagagcaaaaccgatggagctgctccggctttggtggatatgaagaaatggttcgaagaggtgtcgaacaatatagtcatgagggtaatcgttggaagacaaaattttgggtctaagattgtgcaaggtgatgcggaggctgtcaactacaagaatgtcatggatgagctcctacgtctcgctagtttgtctatgttatcggatttcgctcctttacttggttgggtggatatgttccaaggaaacaagaacgcaatgaaacgaaatgccaagaaagttgacaccatactagaaggctggttggaggagcataggaagaagaacaagaagatgagctcatcagaaaatgatgaacaagacttcatggatgttatgctttcgattattgaagagaccaagttatctggccgtgacgctgataccgttattaaagctactgtcttggccatgataatgggtggaacagacaccacggcggttagtctaacatggattgtctccttattgatgaacaatcgtcatgtattgaagaaggctagagaggaaatagacgccattgttgggaaggatagacaagtagaagattcagatttgaagaactttgtatacatgaacgctatcgtcaaggaaacgatgcgattgtatccacttggtgctatgctcgaacgcgacaccaaggaggactgtgaggttggtgggttccaagtacaagccggcacacgattactagtaaacgtatggaagttacaacgagacccaaatgtttggagtgatccatcagagtttagaccagagagatttttatcggagaacgctgatatagacgtcggcggtcaacatttcgaattactaccatttggtgcaggtagaagggtgtgtcccagggtgtcgttcgcgctccaattcatgcatttggtactggctcgtcttatccatggatatgaattgggaactcaaaatgatgagcttgtggacttaactgagagcacagaaggtcatgttaaccatatggcttcccctctagatctcatcctcaccccacgcctcagcaaccctaagctctatgattattag

SEQ ID NO: 150 - DNA, 1557 bp, Glaucium flavum
atgttctttacttcatcttcaaaaaccacaaacaaaaacacaagtaagaaaccacccatggctcccggtgcatggccaatactaggtcatcttcatttgtttaaagaaggtgagttacctcaccacatgcttaaatccatggctgataaatacggccccgccttcctcatgaagttcggccaacaccggtccctcgtcgtcagcgactaccgcattgttaaagaatgtttcactaccaatgacaccttattttccaatagaccgtctacaactgcctttgctgtcatgacttacgctacggactccgtcgcgttcaccgaatatagtccttattggcgtgagcttcgaaagatatccactcttaagctactctcgaacaaccgtctccaggcgataaaaaaactccgagaaagcgaagtgaacgtctgtttccgaggtttatatgattcgtggaggaagaataagagtgaacagaatggtgctggtaatagtattgatggtggtaacgaacgagcacgtccggttctcgtcgacatgaaaaaatggttcgaagaggtgtcgaacaacttagtcatgagggtaattgttggtaaacgtaattttgggactaagattgttgaaggggagaaggaggctgttgagtataagaccattatggatgaactcttacgtcttgctagtttgtctttgttatccgattttgcacctatacttcgtttgtttgatcactttcaaggacatattcgtactatgaaacgaaatggcaagaaactagacgtactacttcaacggtggttggaggagcatcggagaaagatgagcacgccggaggaggagcaagatttcatggatgttatgttgtccattgttgatgagagcaagttgtctggtcacgacgctgatacggttattaaagctacttgcctggccatgataatgggtgggacggacacatcggcggtgagtctaacatggatagtctccttattgatgaacaatcgtcatgcactagcaaaggctagagaagaattggacaagcacgtaggtaaagatagacaagtagaagaatcagatttgaagaacttggtttacttgcatgcaatcgttaaagaaacaatgcgattatatccattgggacctcttctcgaacgcgaaacgaagcaggattgcgaggttggaggattcgatatcgccggaggcactcgtatactagtaaacatatggatggtacaaagagatccggccgtctggaacgacgcgacggagtttataccggagcggtttctaacggagaaatcggatgtagatgtttggggtggtagttttgagcttataccatttggagccggccggagggtgtgccccggcgtgtcgtttgctctacaattcttacatttagtattggctcgtcttatacatggatatgaattgaaaacgccaaatgatatgccggtcgacttaacggagagtactgaagggcatgttaaccataaagcatcacctttggatcttcttctcgtccctcgccttagcgacctgaagctctatgattactag

SEQ ID NO: 151 - DNA, 1614 bp, Glaucium flavum
atggattccattcttacaaccgttgttctcctttccatacttctctactttctattctcatggcagctaaacaaatactctgctactaagaagaataccaaatcatcaaaacagctaccaccagaaccggctggttcatggcccgtcattggtcatctccatcttctcgccaaaggatcaaacttgccccatataaatttgggagccatggctgacaagtatggaccaatcttcatgatccgtatcggcttaaatccaacactggtggttagtagttgggaggtagcaagagagatattcacaaccaacgaccaagttttctcctcccgtccaattcaagtatccacgaaacacttgggtttcgacactgctatgtacggtttcgcaccttatggaccatactggcgtgaaatcagcaaattagtgaagcgtgaagttctatccaacactagactagagttcctaaagcctgtttggggctctgagatcaacacatctatcaaagaattgtatgatgtgtgtgtaatgaaaaacaaagaagaaggtggtactggtccaattattgtggaaatgaagcaatggttctcagatttagcattaaacatgtcggttaagttggtagccggtaagagatattttggtgcttctcaactaggaaatgaggaagctgcgaggtggcaaaaggcactgagaaactgctttaggttggtggggctgtttgttgtgtcggacgcaataccatttctaaggtggttggacgtgggtggtcacgaaaaagaaatgaagaatactgctaaagagttggacgatttgttggagggatggctggaagaacataaaatgaaaaagaagttatcattaagtgaagttgaagctgagaagaaggaaagggatcgggttgacttcatggacgttatgctgtccacacttgaacatgaaaaggcatctgactatttcccggctgatactatcaacaaggctacttgcttggctctaatccttggtgggactgatactaccacagttgtttgggtttgggccttggctctactagtgaataacccgaatgtgttaaagaaggcccaagatgagttggatgtccatgtaggtaagaaaagacaagtggatgaatcagacatcaaaaaccttacatatctccaagccataatcaaggaatcaatgcgtctctacccagcagctacattaggtataagagaatcaacagaggattgcactgtagctggctaccacatccctgcagggactagtttgatagtgaattcttggaagattcaacatgacccacaagtatggactgacccatttgaatttcagccggagagatttctcacaggccacatggacgtcgatattagaggtcagagttgcaaattcctcccttttgggtcgggtagaaggtcatgtccagggacatcactcgctcttcaaatggtaaccttgacacttgctcgtttgatccatgggttcgagttcaggactccgtcagaagcacccactgatatgacagagagcgctggactaactaatgttaaggccaccccacttgaagttctagtctcaccgcgccttccttcggagctttatgtttgttaa

SEQ ID NO: 152 - DNA, 1614 bp, Glaucium flavum
atggagttgatcaactctcttgaaatccaaccaattacaatatccattttagctcttcttactgtgtccattcttctttacaaaattatttggaatcatggaagcagaaaaaataataagagcaacaagaacaacagaaagacatcatcatcagctggagtagtagaaataccaggtgcatggccaatcatcggtcatctccatctcttcaatggaagcgagcaaatgttccataaactcggttccttggccgaccaatatggtccggcgccattctttattcgatttggttcgcgtaaatatgtcgttgttagcaattgggagctcgttaaaacatgtttcaccgcacaaagccaaatctttgtaagccggccacccatgttagccatgaacatcttgtttttcccgaaagattcgcttagttatatacagcatggtgaccattggagagaattgagaaaaatttcaagcacgaaactactttccagtcaccgcgtcgaaacccaaaaacatttgatagcatcagaagttgattactgttttaaacagctttataaactttccaataatggagagtttaccttggtgaggctgaatacttggtgtgaggatatggcattgaatgttcatgttagaatgattgccgggatgaagaattatgttgctgcacctgggagtggtgaatatggcggtcaagctcggagataccggaaagctttagaagaagctcttgatctactgaaccagttcactatcactgacgtggtgccatggttggggtggttggatcattttagggatgtggttggaaggatgaagcgttgtggtgcagaacttgattcgatttttgcgacgtgggttgaagaacatcgtgtgaagagagcctctggaaagggaggtgatgttgaaccggattttattgatctttgctgggagagtatggaacaattgcctggcaatgatcctgcaactgtcatcaagttaatgtgtaaggaacatattttcaacgggagtggcacctcgtcactgaccctagcatggatcctttctttaataatgaataatccctacgtgataaaaaaggcaagggaggaattggaaaaacacgtcggaaatcatcgacaagtggaagaatcagatctccctaatctcttatacatccaagcgatcatcaaagaggggatgagattgtacacaccaggaccattcattgatcgaaatacaactgaagattatgagataaatggtgtccatataccagctggtacttgcttatacgtaaacttatggaagattcaccgagacccgaatgtgtatgaagatccactcgagtttaaaccagagaggttcttgaagaacaattcagatttggatctaaagggacagaattaccaactcctaccgttcggggcaggtaggaggatatgtcccggtgtgtcgttagcgttgccgttgatgtatctgacagtgtctcgactcattcatggcttcgatatgaagttgcccaaaggtgttgaaaaggctgacatgacggcacatggaggtgtaattaaccaaagggcgtaccctttggaggtgctgctcaaaccacgtctcacctttcagcaagcttaa

SEQ ID NO: 153 - DNA, 1716 bp, Glaucium flavum
atggatttacaaatcttcttccacttccaaggaattgtaggctcattagctttactatcattcttctattatctatggagacttttaactacgacgaagacgagtatttgtaacggtacaacggctgcaccacctgaagtttccggtggttggccgatactgggtcatcttttgcagctagtaggatcgaaacagccgttgttcaaggttcttggagacatggctgataaatatggacctatttttgttgtccggtttgggatgtacccaactcttgttgtgagcagttgggagatggcaaaggagtgcttcagtaccaacgatagagtcctagctactcgtccaactagtgctgctagcaagtaccttacttacaactatgccatgtttgctttcacattttatgggccttattggcgtgagattcgtaagatatcaactatagaattgttgtcccatcgacgtgttgagatgttcaagcatgttccgttcatggaaatcgatacgtgtatagaacaactatatcttctttggatgcagaaccagaaccagaaccagaaccaaccgaacggagatccggttcaggtaaacatgagtaaagtatttgaagaactaactatgaatgcggtgttgaagttagtcgtcggaaaacgccttaccgacgacaaagaaggcgaaaagctgcacaagaccattcaagaattctttaaactgttagaggtatcagttgcatcggatgtttttccattccttgggtggctagatgtggatggacaaaagagaaaaatgaaaagggtagctaaggagatggacataatagctgaaaaatggcttgaagagcaccgccaaaagagaagtagtaagttggaggaggaggaggaggaggaggaggacgacggcggcggcaaaggagacgcggcggcggcagataaggatttcatggacgtgttgttatccttattggaaggagatgaaggtgattctgatcaacccttcatgaactatagtcgcgatacagtcatcaaagccacctctctgaatatactcgtggctgctacagacactacatcacctaccttaacatgggctatctcattactactcaacaacccccatgtcttaagagaggcccaaaatgaactagacatgaaggtaggaagggatagacaagtcgaagagcaagacattgagaacctaatctacctccaagcaatcgtcaaagagacactccgattgtacccagctggtcctctctctatcccccatgaggctattcaagattgtaaacttggcggatatcatgtaagggcaggtacacggttgttgctgaacatatggaagctacatcgcgacccacgcgtgtggtcgaacccacttgaattcaagccagagaggtttttaattctatcggaggaggtgtgtggttgcagtcgtggaacacaaaattttgattttaaaggccaatgttttgagtacataccatttgggtcgggacgaaggatgtgcccaggatacaactttggcatacaaatcattcacatgacactagcacgcctacttcagtcattcgagatgcagcctgcaaaagctaaatcgctaaatgatcaagatgggcctgtcgacatgagagaaggttctggcctaacacttccaaagataaccccattaaaagttctccttacaccacgcctctatggtcagctttataatcattag

SEQ ID NO: 154 - DNA, 1605 bp, Hydrastis canadensis
atggacttctccatgctcttccaatggctattggttactatggctacccttcttttcttgaattctgtttacaatgtttggtataaatcttcaaaaaacactagtattactactacgactagtaaaggaaagaaggcaccagtagctgctggtgcacggccgttcatgggtcaccttcatatgttagtagggggcaagcaattgcctcaccaggcacttggaaagttggccgatatatacgggccagctttcatcattcatattggcccaaacccagaacttgttgtaagtagttgggagcttgcaaaggagtgtttcactactaatgacaagtatttcgctaaccgtcctactaacaaagccatgaagtacttgacatacgacgaagcatccgttggctttggaccttatgggccactctgggttgaaatgcgaaaaatagctaaatctaatcttctctctcaacaaaggctccaaatgcataaacgtgtccgagtcttagaaatagacgcgttttttaaagaactccatgagctatggtcgatgaagaaagaggatggtccagtttctgtagacatgaagcaatggtttgaagaattgacacttaatgttatcaccagaatggtttctggtaaacataaatatgcaactaaggcaagacggggtgatagtgaggcgaagcaattcaaaagagtaataggtgaggcagcacattttacaggaaatcttttgctatcagatatatttccatctcttgggttcttggataacatgcaaggtcgtgtgaattccatgaagcgaacaggcaaggaacttgactccatccttagttcatgggttgaagagcatcgccaaaagaaactatcaggagagcagtcagaggatgaagagaaagactttatcgatcttacgttgtccatgatggacgaaattcagctccactcgactgactcagagaccttcatcaaagctatttgcgtgggtgtgatcctaggtgggagcgacacaacatcagtgggaataacatggatcctttctctactaatgaatcatcgcgatgttttgaagaaggcccaagaagaattggatcaacaagttggaatggacagaaaagtagaggattcagatctgaataatttggtatatctcagggcaatcgtaaaggaatcaatgcgtttgtaccaagttgggccacttattgaacgaaaggcatcacaagattgcaccataggcgggttccatgtcaaagcaggaactcgccttttggtgaacctttccaaggtacacaaagacccaactgtgtggtcagatcctttggaatttcaaccggagagatttcttacgacgcactcaaacatggaccttaagggacagcatttcgaactacttccttttgggtcaggtagacgaatgtgtccagggtacttgtttgccctcaatgaaatgtatttggtgcttgctcgtctcattcaaggctttgaactgggaactcctatggatgcaaaggttgatatgacagaaacatcaagtgttaccaactacagagcaacaccccttcaagtattgctcaccccacgcctcagtcctaagctatacgattattaa

SEQ ID NO: 155 - DNA, 1587 bp, Hydrastis canadensis
atggcctttgttgctcttattgttgtttacaatatctggtttaaatctgcagcaagcagaaataagaccagctataataacaaaacaatgagcaagacaccagtagttgatggtgcgaagcccatcattggtcacctccatttgttaatgggaggtgacctgcctcatcatgcgctcggaagattagccgataagtatgggccaatcttccttatgcacattggcgcattcccagaactcgttgtgagtagctcggaactcgcaaaagagtgtttcactaccaatgataaatatattatcaaccgtcctaccaataaggccatgacgtatttgagttacgaacaagcatctgttggttttgcaccttatgggccactttggattgagatgagaaagatctctaaatccaatcttctctctaaccaaaggattcacatgcagaagcaagtacgagtggcagaactggacgcgttctttaaagaactgtaccagctgtgtcgttcaaacgatgaaaacaacaacaacagtactagtcatggtaaagttttggtggagatgaataaatggtttgaagaactgacactcaatgtagtgactagaatgatatgtggtaaacaaaaaatgggtactaaggcaaggcttggggatagcgatgcgaagcattacaaaaaaaccattgatgaggcagcacattttatgggaaaccttgtgatctcagacgtagttccatgtctaggaatgttggacaatttactaggtcatgtgagcgccatgaagcgcacaggcaaggaacttgacacaatctttggttcatgggttgaagaacatcaacaaaagatcagactctctggttataaagatgatgctgaagaggaggagcatgactttattgatcttacattgtccatgatgaagggatcaactgacctccatggtcttgaccctgcaactttcatcaaatctatatgtgtgggtatgatccttggcggcacggacacgacatcggtggccttaacatggatcctctctctactactaaataatcgccatattttgaagaaggcccaagaagaattggaccatcaagtaggaaaagagagaaaggttgaagattcagatctcaacaatctggtctttataggagccattgtgaaagaatcaatgcgtttatacccagttgggcctcttattgaacgtgaggcaatagaagattgtcagattggtggtgtccatgttaaagccggcacgcgattactaataaacatttggaaggttcaacaagatcctaaaatttggcctaatccttcagagtttcgaccagaaaggtttctggattctaacatggatgttaagggccagcatttcgaactcattccttttgggtccggtaggcgaatgtgtccaggaatgtcgttcgccattaatgaattgaatttggtgcttgctcgtcttcttcaaggcttcgagttggaaactccaatgaatgcaaaggtagacatgactgaaacttcaagcgttacgaattataagggaacccctctccaagtacttctcaccccacgtctcagttctaagttatatatgtaa

SEQ ID NO: 156 - DNA, 1596 bp, Hydrastis canadensis
atggagtattcccatcttctcccatggctagcaacttcaatagctgccatttttgctttcatttttctcttttatgtccggaggaggaaaaacaacaaagcctttattcataatcatgccaaaaaagcacctgtggtaccgggtgctttgccgtttcttggtcacctccgcctatttactggaccgattttacctcacaaagcgcttggagcacttgcggataagtacggtccggctttcactatctatctgggaagtcatcaaacacttgtggtcagtggtcgagagttggtaaaagaatgcttcactactaatgatagattgttctctaatagacccagaagtaaggctgtcaagtacttgacttatgatgaagcctcagttggttttgcaccttatggcccactttgggttgagatgcgaaaggtttcaaaactcaattttctttctaatcaacggatccagatgcagaaacaggcactagcctcagaattgaatttttgcttcaaggatgtgtatcaattgtggttgaaaaataaggaactccccgttatggttgatatgaccaaatggtttgaagaaatgacgttaaatgtgataacaagattgatttgtgggaaacaaaactatggatctaaggctaacagtggtgaaagtgaggccaaaaggtataaacaagttgtagaaaaggcagcacatcttacatcaactgttgtgatgtcagatgtgtttccttttcttgaatggtttgataagtttcaaggacaggagaaagtcatgaaaaaagtagctaatgaatttgattcaatccttggttcatgggtcgacgaacatcgtcgaaagagacttcttcgaggcaacaatgaggaggaggaggaagagcaggacttcattgatctttccttggccatgatggaggaaactcagcttcatggtgttgatcctgataccttcatcaagtcaatgtgtttgggcatgatccttggaggaggtgacactacgccggtggccctaacatgggccctttcgctactattgaataacccagatattatgaagaaagcccaagaagaaatagaccaagtcataggaaaagagagaaaattagacgggtcggatataagtaatctggtctacctccaagccgttgtgaaagaatcaatgcggttataccaagttgggccattgattgaacgcgaaacaactgaggattgtaagattggtgacttccatgttgaagcaggcacgcgtttactagtaaacatttggaaagtacaacaagatccatgtgtgtggtcgaaccctacggagtttcaaccggagagatttctttctagtaagtcagatatggatcttaagggtcagcattttgaactaattccttttgggtcaggtagacgaatgtgtccagcagttgcttcagctctccaaatgatgcatttggtgcttgcaaaactcattcatggctttgaattaggaactcccatgaatgcaaaaatcgacatgacagaaacttcaagtataaccaacaacatggcaactcatcttcaagtgctactcaacccacgtttaaatgctaatctttatgatttttag

SEQ ID NO: 157 - DNA, 1632 bp, Hydrastis canadensis
atggcggatttcaccatgctcctccaatggttattgcttaccatggctacccttcttttcttgaatgctgtttacaaaagtattaaatcttcaaaaaacactattaatgataccagttttaaaaaaggaaagaaggcaccagtagctgctggtgcaagaccctttattggtcacctccatatgttagtaggaggcaaacaactacctcatcaagctctcgggaagttggccgataagtatgggcctgccttcatcatcaatattggtccaaacccagagcttgtcgtaagtagttgggagcttgcaaaggagtgtttcactataaacgatcggtgtttcactgatcgtcccagtaacaaagccatgaagtacttgacctacgacgaagcctctgttgggtttgcaccttatggccctctctgggttgaaatgcgcaagattgctaaatccaattgcgcatttcaacaaaggctccaagtacagaaacgtgtacgtgtcttagaaattgacttattttttaaagagctccacgagctatggtcccacgctggtgctggtgctaccggtactagtgtaattcctctttccatagacatgaagaaatggttcgaggaattgacactaaacgtgatcaccaggatggtgtctggaaaacataattatgcaactaaggcaagaaagggtgatactgaggcgaagcgattcaaaagagtgataagtgaggcagcacattttacaggaagacttctgctctcagatatatttccatcacttgggttcttggataacatgcaaggtcgtgtgaactccatgaagcgaacaggcaaggaacttgattcggtccttagttcctgggtggaagaacatcgccaaaagagagtctctggaaataaagagcagtcacctgaggatgatgatgtggaacaagattttatcgatctcacgttgtccatgatggaggaaattcagcttcactggactgacgctgacaccttcatcaaagctatctgcgtgggtgtgatccttggggggagcgacacgacatccgtgggcataacatggattctttctctgctaatgaatcatcccgatgttttgaaaaaggccagagaagaattggaccaacaggtaggactggaaagaaaagtggacgattcagatctcaataatctggcctatctcagagccattgtaaaggaatcaatgcgtttgtaccaagttggcccactgattgaacgtaaggcaaaacaagattgcaacataggtgggttccatctcaaagcaggcacacgcctacttgtgaacctttccaaggtgcacaaagacccgactgtgtggtctgatcctaatgagtttcgccccgagagatttttcaccacccacaccaacatagatatcaaggggcagaattttgaactcattccttttgggtctggcagacgtatgtgcccagggtacttatttgctcttagtgaaatatatttggtgcttgctcgtctcattcatggcttcgaattgagaactcccaatgatgccaagcttgatatgacagaaacttccagtgttaccaattacagggcaacacctctccaagtactactcactccgcgcctcagttctaagctctactga

SEQ ID NO: 158 - DNA, 1599 bp, Hydrastis canadensis
atggactacttttccatgccttaccaatggttactaacttccttagctactcttattgtctttgtttttatctggtctattactgctggaaaaacaagtactacttctaacaaagcgaaaaaggcaccgccaatagcggctggtgcatggcccattatcggtcacctccatttgataatggggggtgaactccctcatcgattgctttcgaatttagccgataaatatggcccaatcttcatgctcaactatggttcacaacctggattagttgtgagtagcttgaagcttgctaaggaatgttttgttcataatgatagagctgtttttaaacgtcctaatagcaaagccatgaagtatttcacttatgatcaagcttcatttggttttgcaccttatggaccactttgggttgaaatgagaaaagtgtctaaatcaaatcttctttctaaccaaaggcttcaattacaaaggaatcaacgtgcctcagaagttgatgcttttataaaagagctttaccaactatgtaagaagtccaacaatggtactcttatggtagaaatgaataaatggtttgaagaattgacacttaacgttgtgactagaatggtttgtgggaaaaaaaacattggggctaaagcaaggcatggtggtgataatgaggcaaaatattataagaaagttatagatgaagcaacaatatttacagctaaattggtggcttcagatttttttccttctcttggatgggtagattatttgcatggtgatgagagtgctataaagcagacagccaaagaacttgattccatcattggttcctgggtggaagagcatcgtcaaaagagactactctcgctcaataaagacgactacgcagagcaggattttatcgatattacgttgtccatgatcgaccaaactcagcaccagggtattgatgctgataccttcgtcaagtctatgtgtgtgggtatgatctttggtgggagtgacagcacatcggtggccctaaattgggctctttcaatactaatgaataatcgacatgttttaaagagggcccgagaagaaatcgacacacttgtagggaaggacagaaaagtgaacgatgtggatgttactaaattggtttatctcaaagccattgtaaaagaatcaatgcgtttatgcctagttggaccgcttcttgaacgtgtgaccgtagaagattgcgagataggtggtttttatgtcaaagcaggctcgcgcatagtggtaaacatatggaagttgcaacatgacccagacctgtggtctgatgatgttatggaatttcgaccagagagatttctcacaaccaactcaaatgtggaacttaggggtcaacattttgaactcattccttttgggtctggtagtcgaatgtgcccaggtgtaacattcgcactcgaactcatgcacttgacacttgctcgtctcattcatggatttgaacttggtacccctatggatgcaaaggttgacatgacagaaacttcaagtgttaccaattacaaggccacaccccttgaaatccttctcaccccacgccttcatcctaagctttatgatttttag

SEQ ID NO: 159 - DNA, 1605 bp, Hydrastis canadensis
atgtttatatcgatcactcaacaatccatggattcatttcaccaatatctagcaactataatttttggtgtcttttcctttgtattattcttgatctattatctaccattgaagagaagtagaagtgataaaaagagagctgctcccaaaccggtcggggcatggcctatcataggtcacttgcctatgttatcccggcaccaaccaccgcacataacgttgggaaatattgctgataagtacggaccagctttcactcttcagcttggcgtgcatcgagcattggtggtgagtagttcagaggttgccaaggagtgtttcactaccaatgacaaggccttagcttcccgcccaagctctgtggctttaaagctaatgggttataacaatgctatgtttggcttcggcccttatggttcatattggcgacaaatgcgcaaaatagttgtacttgagcttctctcaaaccatcggctccaattgctaaaacacgttcgtatatctgaggttagcacatctttaaaagaattgtaccaggtttgggcatcatgtactaataagaacgacaaaggacaagttttggtggatatgcagcaatggtttggtgacttgacactaaacgtctccgttaggatgattgctgggaagcgatactttggtgccagtgcagcatgcgacgaagatgaagcgaggaggtttcagaaggcgattaaagatttcctccatttagtaggcttgtttgtggtgtcagacgcgcttccctttctagaatggctagatattcagggtcatcagaaagccatgaagagaactttcaaagaattagatagaatacttgggaaatgggtggaagaacatcgacgaaataaattagacggtggaacgaatgtgggacgagacttcatggatgtgatgtcttcgatacttgacgatgcaaatatctctgattatgatgctgataccattaacaaggctacttgcctgagtctgatcttgggtgggactgacaccacaatggtcactctaacatgggctttatccttattaatgaacaatcaacacatattgaagaaggcccaagatgaaattgacatctatgttgggaaagataaaaacgttgatgaatcagatatagagaaactggtgtacctccaagccattgttaaggaaacattgcgtttgtacccagccggtccactatctgggccacatgaggccatagaggactgcactgtagctggttatcatgtaccaagaggcacacgcttgataacaaatctctggaagattcaacgagatccacggatatggtcgagcccttgtgagttccaaccagagagatttctcaccactcaagcaaatgtggatgttaggggccagcattttgagtttcttccattcgggtctggaagacgttcgtgccctgcgacctcatttgcacttcaagttgtgcacttagcattagcacgtgtattacaaggcttcgagtttgaaactcaatcaaatgcacctgtggatatgaccgagagcgcgggacttacaaatgtcaaagccaccccgcttgaagttctaatcaccccgcgcctccctttgaatctatattaa

SEQ ID NO: 160 - DNA, 1590 bp, Hydrastis canadensis
atggagtcgcttcaccaatatctagcagcagtcatgagttgtatctttgccttgttactcttcctctattatttcccatggaagatcagaagaagtagctctgataataacatgagaagtgcacctgaagcagctggtgcatggcctatcataggtcacttgcccatgctgggagggcaccaactaccccacataacgttgggaaacttggccgataggtacggaccagccttcactatccggcttggtgtatgccgggcactggtggtaagtagttcagaggtcgcaaaggagtgtttcactaccaatgacaaggcctttgccacccgcccaagctctgtggccgtaaagctaatgggctataactatgcactctttggcttagccccttatacttcttattggcgtgaagtgcgcaaaatagtaatactggagcttctctccaatcgtcggctagagttgctaaaacatgttcggatctctgaggtcaacacatctataaaagaattgttccaagtttgggcatcatcaaataataagaatgagaaaggacaagttttggtagagatgcagcgatggtttggtgacttgacaataaacgtagctgttaggatggttgctgggaaacgatacttcggtgctagtgttaatacgtgcgatgatgaggaggaggcgaggaggtttcaaaaggcgattaaaaatttctttcatcttgtagggttgtatgtgttatcggattctcttccatttttggagtggttggactttgagggtcatcaaaaggctatgaaaagaactttcaaagatgtggactgtatacttcaaagatggttggaagaacatcgacgagataaagagaatggtgcaatgaaggaggagcgagacttcatggatgtgatgttgtcgatccttaaagatgcaaatctctttggttacgaagctgatactgttaacaaggccactagtctgaatataatattgggtgcaacagacactacaatggttactctaacatgggccctatcgttattattgaacaatcgacacatattaaagaaggctgaagatgaaattgacatccatgttgggaaagataaagctgttgatgaatcagatatagagaaactagtatatctccaagccattgttaaggaaacattacgtctgtacccagttgctccactgttagcagcacatgaagccatagaagactgcattgtagctggttatcatgtaccaagaggcacacgcttgataccaaatatttggaagattcaacgagatccacgcatatggtctagtccttgtgatttccaaccagagagattcctcacaacccaagcaaatgtggacgttaggggtcagcatttcgagttgtttccttttgggtctgggagaagaatgtgcccagggatctcatttgggcttcaagtagtgcacttggcactagcgcgtgtattacaaggcttcgagtttgatactccatcaaataaagctatagatatgactgaaagcgcaggacttaccaacctcaaggccacccctcttcaagttctaatcaccccgtgcctccctttgaatctgtattaa

SEQ ID NO: 161 - DNA, 1593 bp, Hydrastis canadensis
atggattcaattttactaccaactccattaatggtcagtctctttgccttactattatgtctttactatttaatcatatcgaggccaaggtctagtcataatactagtactaaggaggcacccgaagccgctggagcattgcctattatcgggcacctccatttgttaggtgggcgaatattgcctcacataacattaggagccatggctgataaacatggaccagccttcatgattcgcattggtgtacatagagcattggtggtaagttcttcagaagttgcaaaggagtgtttcacaaccaatgacaaggctttcgcttctcgtcctaagcatacagcagcggaactcatgggttataattatgccatgtttggatttgcaccttacggtcctttttggagcgaaatgcgcaagataatcatggctgaactcctctccaatcgtcggcttgagttgcttaaatacatccgggatttcgaattaaaagcatctatcaaagaactatacatgacatgggagaaccacagtgttactaataaaggtcaggtagtagtagaaatgaagaaatggtttggagacttaactctaaatgtgattctaaggatgattgctgggaaaagatactttggttcaaattctacttgtgatgaaagtgaagcaaagatatgtcaaaagggtatgagagatttctttaggttattgggagagttccttgttgaggatgcaattccttatttggggtggttggacttgcaaggttttaaaaaagagatgaagaatacagctaaagaacttgatattcttcttcaaggatggttggaagagcacaaaaaaaagagggagttctctaaggatgttaaggaagagcaagacttcatggacgtgatgatgaccatacttgaagatgcaaacttctctgattttgatgctgatactatcaataaggctacgtgtttgactataatctcaggaggaagcgacactacaatgcttactctaacatgggccctatccttactactgaacaatcaacatgtgttgaagaaggcccaagatgagttggacacccacgtcggtagggatagacgcgtggacgaatcagacatcaagaacctcgtctaccttaacgccatagtgaaggaaacattgcgcttatacccagctagtccactactgggtattcgggtgtccacagaagactgcactgtagctgggtaccatgtcccatcagggacccgtttaatggtaaatgcttggaagattcaacgagacccgttagtgtggtccgacccatttgaatttcgcccagaaagatttctcacaacccatgtaaatgtggatgttaagggtcaaaattttaatttaatcccatttgcatcaggtagacgtgtgtgcccaggagttgcatttgcccttcaaatgctgccactagttctagctcatttgctacatgggttcaaactcatgactcagttgggtggacctgtcgatatgactgaatccactgggttaactaatatcaaagcaactccattggaagtagttatcagcccacgtcttcgtccagaactgtatgaaatgtacacatag

SEQ ID NO: 162 - DNA, 1578 bp, Hydrastis canadensis
atggagtcgcttcaccaatatctagcaacaattttgagttgtatctttgcctttttactcttcctctattatttcccatggaagggaagaagaagctttgataataacttaagaactgcacctgaagcagctggcgcatggcctatcataggccacttgcctatgttaaaccaacgtgatttaccccacgtaacgttgggaaacttggcggataggtacgggccagccttcactatccggcttggtgtacgccgagcactggtggtgagtagttcagaggtcgcaaaggagtgtttcactaccaatgacaaggcctttgccacccgcccaagctctgtggctgtaaagctaatggcctataactatgcagtctttggctttggcccttatggttcttattggcgtgaaatgcgcaaaatagtaatacttgagcttctctctaatcgtcggctagagttgctaaaacatgttcggatctctgaggtcaacacatctataaaagaattgtaccaagtttgggcatcaaataataagaatgagaaaggacaagttttggtggagatgcaacgatggtttggtgacttgacaatgaacgtagttgttaggatggttgctgggaaacgatacttcggtgctagtgttacgtgcgatgaggaggaagcgagaaggtttcaaaaggcgattagagattttagtcatcttgctggtttgtatgtgttgtcggatgctcttccaaatatagagtggttggactttgagggtcatcacaaggccatgaaaaaaactttcaaagatttggactgtatacttcagagatggttggaagaacatcgacgagatagagagaatggtgcaacgaagggagagcgagacttcatggatgtgatgttgtcgattcttaaagatgcaaatccttttgatttcgaggctgataccgttaacaaggctactagcctgaatatggttttgggcggaacagagactacaactgttactctaacatgggccctatcgttactattaaacaaccaacacatattgaagaaggcgcaagatgaaattaacatccgtgttgggaaagacaaacctgttgatgaatcagatatagagaaattggtgtacctccaagccattgtcaaggaaacattgcggttgtaccctgtccttccattatccgtaccccacgaggccatagaagactgcaccattgctggttatcatgtaccaagaggcacacgcttgataacaaatctatggaagattcaacgagatccacacatatggtctagtccttgtgagttccaaccagagagattcctcacaacccaagcaaatgtggacgttaggggtcagcatttcgagttgtttccttttgggtctgggagaagaatgtgcccagggatctcatttgggcttcaagtagtgcacttggcactagcgcgtgtattacaaggcttcgagtttgaaactccatcaaatgtacctatggatatgactgaaagcgcaggacttacgaatttcaaaacaacccctcttgaagttctaatcaccccatgcctccctttggaccaatattaa

SEQ ID NO: 163 - DNA, 1578 bp, Hydrastis canadensis
atggattctcttctccagttacaaataattggagcacttgctgccttaatattcacttacaaactattgaaagtgatatgtagaagtcccatgactgatggcatggaagccccggaacctccgggagcttggccgattatcggacacctccatctgctcggtggccaagacccaatagcccgtacacttggagtcatgactgataaatatgggccaattttaaaactccggcttggtgtacatactgggcttgttgttagtaattgggaactggcaaaggagtgtttcactacaaatgacagagttttagcttcacgtcctatgggtgcagcaggaaagtacttgggctataattatgcgatatttgggctcgcgccgcatggaccatattggagtgaagtacgtaagatagtattacgtgaacttctctctaatcagagtttagagaagcttaaacatgttcgaatctccgagattaatacatgcttaaagaatttattttcattgaacaatgggaatactccaataaaagttgacatgaagcaatggtttgaacgcccaatgttcaatgtggtcactatgatgattgcagggaaacgatattttagtatggagaatgacaatgaggcaatgaatttcaggaaagttgccactgaatttatgtacttaactggggtgtttgtagtgtcggatgcccttccatatctggagtggttggatttgcaaggacatgtgagcgccatgaaacgcacggccaaggaattggacatccatgttgggaagtggcttgaggagcatcgtcgtgctaagcttctgggtgaaactaaaaatgaagatgattttgttgatgtgctgctaaccatcttgccagaggacttgaaggataatcaaacgtatatacatgaccgcgataccatcatcaaggcaactgcactggctctttttttagctgcctcagatactacagctatcaccttgacatgggctctatcgttgatactcaacaatccggacgtcttgaaaagagcacaagatgagttggacaaacacgtcggtaaagaaaaactcgtcaaagaatcagacatcataaatctagtgtacctccaagctatcatcaaggaaaccttacgcctgtatccagctgcacccctcttattgccacatgaagccatggaagattgtacggtaggtggctatcatgttccaaaagggactcgaatttttgttaacatatggaagttgcagcgtgatccgcgtgtatggtttgatcctaacgagtttcgaccagaacgattcttaaccactcatgcaaatgttgattttaagggacagcattttgagtacatacctttcagctctggtagaagggtatgcccagggatcacatttagtacccaaatcatgcacttaacacttgcccatctacttcatgaattcaacatagtgacccctacgaaatcaaatgcaggggttgacatgactgagagcttaggcatcacaatgcctaaagcaactccactagaagtacttctcactccacgtcttccatctaatctgtacaatcaatacagagactaa

SEQ ID NO: 164 - DNA, 1566 bp, Jeffersonia diphylla
atggattcacttcaactcatagctagtgttgtgtgtggattgtttgccttccttcgtatctactacttactaaagaagttgtctagtaacaaggaggcaccccaactcggtggagcatggccgattatcggccacttacatctattaggccgagttgagctcccccacatattttttagtgccatggcagacaagtacggtccagccttcatgattcagcttggtatgcgacgagcactagtagtgagcagtgcggagattgccaaagaatgtttaactacaaatgataaggccttagccactcgtccaagttcaatagcagctgagattatgggttatgactatgctatgttcgggttaggtccatacggggactattggcgtgaagtgcgcaaaatagtggtcttggagtttctctctaatcgtcggcttgagttgctaaaacatgttagggtgtctgaaatatccctgtctctgaaagagttgtaccaatcctgggaaaaacaaaacaaagctgatgaaccagttttagttcatctggaccaatggtttggcgatatgacgctcaatctttcagttagaatggttgctgggaaaaggtactttggtgcaactgctgcttgtggtgaagatgagtctaggaaagttcaaaaggcaacaagggaattcgataggcttttgggtctgtttgtagtgtcggattatcttccttttctgcggtggctggacttggaaggtcaccagaagttgatgaagagcataggtagagaacttgattctattctgcagggatggttggatgagcataaaactaggaggaactctggtggaggagctaagggagatcaggatttcatagacgtaatgctttccgtccttgaagatggaaacctttccaattacgatgctgataagctcaacaaggctacatcacttacgatgattgtagctggaagcgaaactacaatggtcactctaacgtgggctgtctgcttgttgctaaacaatccggaagtgttaaacaaagctcaagatgagttggacatgcacattggcaaggacagacaagtggaagaatcagacatcaagaacctggcatacctccaagctgttatcaaagaaacgatgcgtttgtacccagttgctccactattaattccccatgaagccatggaagactgcaccatagctgggtatcatgttcgagcaggcacacgagttatactaaatggttggaagcttcaacgagacccatttatttggtctgacccttgtgagttccaacctgaaagatttctcaacaacgatgtggatgtgagaggtcggcattttgagttattgccatttgggtcaggtagacgtgcatgccctgggatttcattggcccttaatgtggtgtctttgacattggctcgtttgttacatgagttcaagttttcgaatccttcagaaggcaaggttgatatgtctgagagtgcaggggtggttgttgccaaggcaacacctctggaagtacttatcattccacgcctaccttcaaagttttacgagtactataagctatag

SEQ ID NO: 165 - DNA, 1557 bp, Jeffersonia diphylla
atgttttctcttcagttgctatcaactccattgtttggcttctttaccctgctggccatttactatctcttatggactaagagtaacaaaaccaaggaagcacctcaacctgctggagcatggccaataatcggccacctccatctactagccaggagtgaactcccccatataactttgggagccatggccgataagtacggtccagctttcatgatccgccttggtacacgccaagcaattgtagtgagtaattcagagattgcaaaggagtgcttgaccatcaaagataggatcttcgctactcgtccaagcttagtagcatttaagctcatgggctacaactctgccatggtcgggttaagcccttatggaccttattggcgggagttgcgtaagataatcgcgttaaaagtcctctcacaacgtaggctggagtctctaaaggatgtgtgggactcagaaatatcctcatccttaaaccacttgcaccaaatatggtcacaccaaaccgaacccaatggaaagattttagttgaaatggatcaatggtttggtgatctaacactaaatgtggcagttaagatggttgcagggaagagattctttagtgctgatgctgcttgtgatgaaaatgagtctagaaggtgtcaaaaggcaataagagagttctttaggcttttgggtcaatttgtagtatcagattctcttccatttctagggtggttggacttggaaggttatcagaaagagatgaagagtacagccaaggaagttgattcaatacttcagaaatggttggatgaacataaacagaaaagacaatctgcaggagctgatagagatcaggatttcatggacgtgatgctttctctcctagaagatgcaagcctctcccaatatgacactgataccatcaacaaggctacctgcttttcaatgatcgtaggtggaagtgatactacgaagatcacactgacatgggctctcaccttactactaaataatccagatgtaatgaaaaagagccaagacgagttggatatccaggttggaaaagataggcatgtcgaagaatcagatatcaagaatctagtatacctggaagctatagtgaaggaaactttgcgtttgtatccagctgctccactattagctccccacgaggccacagaagattgtattgtagctgggtataatgttcgcgcaggcacacgcttaatagtgaacgcttggaagattcaacgagaccccttgatttggccgaacccttctgagtttctaccagagagatatcttaacaaagatgtcgacgttaaaggacaacattttgaattaatcccatttgggtcaggtagacgtgcttgccctggaatcacatttggacttcaagtggtatccttgaccttggctcgtctcctccatgagtttgagatttccattgcatcaggaattaaagtggatatgacggagagcggaggtctagttactgccaaggccacccctttgaaagcacttatcgccccacgctttctttattctcatcatcacatttag

SEQ ID NO: 166 - DNA, 1578 bp, Mahonia aquifolium
atgaattcacttcagttcctagcaactccattgcttactctcattgcattactatgtgtttactgcatagtatggagaaaatcattctctagaaacggaagcaaaataaagcaggcgccctgggcaggtggagcatggccgatcatgggtcacctgcatctactagcctggggtgacctcccgcatataacgttgggagccttggccgataagtacggcccagtcttcatgatgcagcttggcatgcgccaagcaatagttgtaagcagtgcagagattgcaagagagtgtttcaccactaatgataggatcttagcaactcgcccaagctctatagcagttaagctcatggcctacaactacgccatgtttgcatttgccccgtatgggcctaattggcgtgaaatacgcaagacagtcatgcttgagctcctctccacccctcgcctcgagtcactcaagcatgtctgggaggatgaaatatccacgagtgtcaaagagttgtatgaattatgtgccagcaaaaccaaaacccatggccatgtttcagtagacatgaagcaacggtttggtgatctgacactcaatgtgttagtgaagttggttaatgggaagagatactttggtgcaaatactgattatactgaacatgaatcaaggaggtgccagaaggcagtgagggattttttcagtcttatggggttgtttgtggtatcagattttcttccatttcttgagcggttggacttgcagggttatgagaaagagatgaaaagggtagctagagaagttgatggtatagttcaagggtggttggacgagcataaaaggaagcgagagtccagtgaaaccacccacgatcaggacttcatggacgtgatgctttcgatacttaaagactcaaaattctctaactctgattatgatgccgataccatcaacaaggctacatgttttaacatgatcttaggtggaagtgacacaacaatgagcacaatgacctgggctttatcggcactgctaaataatccacatatgttgaagaaggcccaagatgagttggaattccatgtcggaaagggtagacaggtggaggaatcggacatcaagaagctaacatacctacaagctataatcaaagaaactttgcgtttatacccgtcggctcccctgttagctccacgtgaagccacagaagactgcaaaatagcggggtatcatgttccagcaggcacacgcctaatcgtgaatgtctggaagattcatagagacccatttgtttggcccaaccctaacgagttccaacctgaaagattcctaaataaagatgtggatgttaagggtcagcatttcgaattgatcccatttgggtcagggagacgtgcttgccctggggtatcattaggacttcaagtggtgtcactgggcttggcgcgcctcctacacggatttgagctttcgatcccatctggaagcaaggtagacatgactgaaactgcaagtctagttactttcaaggcaacgcctctggaagtatttatcactccacgcctatctccacatatgtatgtggagtag

SEQ ID NO: 167 - DNA, 1511 bp, Mahonia aquifolium
cttatgcatggaagaggaaaaaccatacaaaggatagcaaaatcaaagagccaccccaaccagccggagcatggccgataatcggccaccttcatctaatatcccgcggcggcctcccccatataaacatgggggccatggcggacaagtacggtccagttttcatgatccggctaggagtaaatcgagccgtgattgtgagtaactcggagatcgtaaaagagtgcttcacaacaaacgataaattcctactaaaccgtccagttgggttggccttaaacctcatgagttacaacaacgccatgttcgggttctctcggtacggtccatattggcgtgagatacacaaaatagtcatgcttgagctcctctcgagcagccggctcgagtccctgaagcacgtatgggactcggaaatattgacatccatcgaagagttgtaccaattatgtcaaacacaaaacaaggctcatgaaggcccagttttggttgaaatgaaggattggtttgcagatatggcactcaatgtgtcctttagaatggttgctgggaaaagatactttggtgcaagtgctggtggtaataaagatgaggcaagaaggtgtcaaaagaccatgagagatttctttagacttgttggcttgtttatagtgtctgatgcacttccatttcttaggtggctagacttgggagggcatcagaaggagatgaagagaacatttgaagatcttgactatgtgcttcaaggatggttggatgagcataaattgaatagaaaatctggtgggaatggtgatcaagatttcatggatgtgatgttatctactctttatgattcaaaatttaccgattacgacgttgacaccatcaacaaggctacgtgctttcaattgatcctaggaggaactgatactacaacggtcactctaacatgggccctttccttgatgttaaaccacccacatgtattgaaaaaggcccaagatgagttggacatccaagtaggcaaacacagacaagtggaggaatcagacatcaagaacctaaaataccttgaagctgtgatcaaagaaaccttacggatgcgcccagtaggcccacttttaggcccacgagaggcgatcgaggactgcaccattggtggatatcgagttcgagcaggcacacgcgtaatggtcaatgcttggaaggtgcaacgtgacccatcggtttggccaaaccctgatgacttcaaaccggagaggtttctcaagaaggatattgacttcagggaccaaaactttgaattcatccctttcgggtccggtagaagggcctgccctggaatatcatttgccgtggaactaytgcccatggctttggcccgtttactacatgggtttgagcttaagactcaattgggttgcaaggtggatatgacagagcatgccggtttagttcatgctaaggctacccctttggaagttcttgtcagcccacgcctgtctcgagagttgtatgtatcgtcttag

SEQ ID NO: 168 - DNA, 1590 bp, Menispermum canadense
atggattcaactgatcatcacctggcccttgtaatacccactcttctagctacccctgtcttattgttctccttctactgtctcctcttgagaccaaggagtctcaaaaaacctcgtactaacaaaccacctgaaccttctggttcatggcccatcatcggccatctccatctcttaagccaaggcctacctcacataacactgggagccatggccgacaagctcggaccagccttctcaatccgcctcggcacgcgccgagcactagtggtcagcagctgggaggttgctaaggagtgttacaccaccaacgaccgagccttcgcgagccgtcccagcagcatagcagtcaagctcatgagctacaacaactccatattggggttcgctccgtacggacagtactggcgcgagctgcggaagatagtggtgctccagcttctctcgaaccggaggctcgagtcgctgaagaacgtttgggaatctgagattgatttgtctataaaggagttgtacgatacatgggcaagtaatagaggaggagaagcgttaatggtggacatgaagcagtggtttggagaccttacgatgaacatagtggtgaggttggtggtggagaagcgttgttttgggagaagcgtgggtgacgatgagactgaggcgaggaggggccagagagcgctgaaagagtttttaaaactggtgggtttgtttttggtggaagacgcgtttccatttttgagttggttggatgttcaggggcatcagagagagatgaagagaatagcgagagaactggactcgctgtttcaggggtggttggaggaacataagaggaagagaagcataaaaggtgaggccaaaggagatcaggacttcatggacgtgatgttgtctgtactcgaggattctaccatcagcactgatatagaagatgacacagttatcaagtccacatgcttgactgttgtcttgggagggagcgacagcacagtgggaactctcacttgggccctctccctactcctaaacaacagacacgaattgaaaaaggcccaagatgaattggacgcctatgtgggtaaggaaagacaagtggacgaatcagacatcaagaacctcgtgtacctacaggccatagtcaaagaggttctgcgactctacccagcgggcccactatcaggcccacgagagtccgttgaggacactgtggtagcaggttaccatgttcccaaaggcacacagctcatagtgaacctctggaagattcaacgtgagccgtccatctgggccgaccctctagagtttcaaccagagagatttctcacgacccacaaaggcatggacgtgtggggccagcacttcgaattaatcccttttgggtccgggagacggtcgtgcccgggcacagcgttcgcccttcaagtgattcacctcacattggctcgtttgctacatgggttcgagctcaccacaccatgtggtgcacctgtggatatgagtgagagcgctggtctcattaatgtcaagaccacgccagttgaggttcacgtcgctccacgcctccctctcaagctatataaatcataa

SEQ ID NO: 169 - DNA, 1590 bp, Menispermum canadense
atgattttaattgcaatgggcaaccacattgaactgcaagatatcatactgtattcccttggattttttgctgctactattttatggagaatttttagtacctatgtccttagaaggaacagttgctccagaccaccagaagcagccggaaaattgccgttaattggtcaccttcatcttctaggagcgaacaagatattacatcatacacttggagacatggccgatcgacacgggccaatcttttctttgaatttgggaattaaaagaactcttgtgatcactagttgggaagtagcaaaagaatgttttacaacacaggacagggttttcgccactcgtccgaaatctttagttggaaaagtagtaggatataatagcacagttatgatatttcagcagtatggaccatactggcgcgagatacgcaagctagcaatgattgagcttctgtcaaatcgtcgactggaaatgctcaaacatgttcgggaatcagaggttaatcttttcatcaaggagctatatgagcaatggtcaagcaatgagaatggaagcaaggttgtggtggaaatgaaggaaaggtttggagatctgacaacaaatattgtggtcaggacagtggcaggtaaaaaatattctggtactggtgtgcatggtaatgaagagtcgaggcgatttcagaaggcaatgacagattttatgcacttagcggggctgtttatggtttctgatgcacttcccttgctcggttggattgatacattcaaaggatacaggggaaaaatgaacaagacagcagaagagattgatcatgtacttggaagctggttgaaggagcatcagcagaaaagaaaaaatatcagcattaatcatttagacgaagactttatccatgtcatgctctctgccatggacgggaaccagtttcctgacatcgacaccgaaactgccatcaagggcacttgtttaagtcttatcttaggtggttatgatacaacatccgccacacttacgtgggcactctccctaatcgtcaacaaccatcatgtgttgaagaaagcacaagatgaaatggacaagtacgtaggaagagatcgccaagtaaaggaatcagatgtgaagaatttaacttatttgcaagccattgtcaaggaaacactgcgattatatccagcagcaccactatcagtccaacacgaagcaatggaagattgcacggtggcaggatgtaacattccagctggcacgcggttagttgtgaacctctggaagatgcatcgtgacccgaaagtttggtctgaccctctagagtttcaaccagacaggttcctgcaaaaacatgttaatgtggacatttggggtcagaattttgagcttttaccatttggatcaggacggaggtcatgccctggtatcacatttgcgatccaggtcctgcacttgacacttgctcaattgcttcatgcgtttcaactgggaactgtctttgcctcgcccattgatatgactgaaagttcgggtgttactaacccaaaagcaactccactgcaagtaactcttaccccacgactgcctcctgaagtctactaa

SEQ ID NO: 170 - DNA, 1542 bp, Menispermum canadense
atggattcaacctaccaacttctctctgccctattgttcatcctctgcctttactatctcgtctgtaaaccaatcaccaaaacaaaaaacgacgaagctcctgtaccagccggagcatggcccatcatgggccacctccacatgctccgcggcccaaacctccctcacataaccctttcatccatggccgacaaacacggcccggccttcacaatccgactcggtacgcgccgagccctcgtagtcagcaactctgatctcgcgaaggagtgcttcacagtaaacgacaaggccttctcaacccgcccgagcaccgtagccacgaagctcatgggctacaacaacaccatgttcgggttcgccccgtacgggccgtactggcgcgagttgcggaagatagtgatgaccgagcttctgtcgagccgaagactcgagtcgctcgcgagcgtttgggcctctgagattgagtcctcggttaaagagttgttcgcggaatgggctgaaaacagggcgaagggtccagtggtggtggagatgggagagtggtttggaaacttgacgctcaacatagcgcttcgaatggtggtggggaagaggtatttgagagaagagtcgcggaaatgcttgaaagcgatgagggattatccggagctgtttgggaggtttttggtggaagacgcggttccgtttcttgggtggttggacttgattcaggggtatcagagagaaatgaagaaaacagcgagagaactggactctgttcttgaaaaatggctagtggaacataaagataagagaggttctggggaggggaaaggagagcatcaggacttcatggacgtgatgatatcggtacttgaagattcaaagctcagttacggagaggctgatacggtcaataagtcaacttgcctgaatctaatcttaggtgcaactgacacaacaatggtggctctcacatgggccctctcacttctactcaacaataaacaagtcctcaaaagagcccaacaagaactaaaatcccaaatcggcaataacaaacaagtgtcccaatccgacatcaagaacctactttatctccaagccacagtaaaagaagcactgcgactttacccaccagagccgctatctggcccgcgagaggccctcgaagactgtaccgtcgccggctaccgtgtccgagccggcacacggctgatagtgaacctgtggaagattcatcgagacccgtcgatatggcaggtccctctcgagttccggccggagaggtttctcacggcccacaaagatgttgatgtgtggggccagcacttcgagctgatgccgttcgggtcgggcagaaggtcgtgcccgggcatctcgtttgttcttcaagtggttccgttgatattggctcgtttgctacacgggttcgaactcacaacgcctggcgaggctttagtggacatgagcgagagcgcaggtcttgtgaacgccaaagtgacaccccttgaagttgttatttctccacgcctcccgctcgagctctttgcgggttaa

SEQ ID NO: 171 - DNA, 1605 bp, Menispermum canadense
atgattatgatgttcatcgactactactcctcatggcttccccaaactctactacttcaatcaattttactagctgtttccctagtcatcttcatcaatctctttctcacgaggaggaggagctactcctccaaatcccacaccaatatcatacaccctcccaaggccgccggagccctgccggtaataggccacctctacaccctctttcgaggcctctccgccggcgttcctctctaccggcaactggatgccatggccgaccgttacggccccgcgttcatcatccaccttggcgtctaccctaccctcgtagtcacgtgccgagaactcgccaaggaatgtttcactacaaacgaccaaacctttgccacgcgccccagcacgtgcgccggcaagtacatcggctacaactacgcgttcttcggcttcgcgccctacggcccgtactggcgcgaagctcgcaagatcgccaccgtcgagctgctctccaactaccgcctcgactcgctgcgccacgtgcgagaagctgaggtggggcgcaacgtggacgagctctacgccctccacgcgtcgtcatcaacgaataagcaaaacatgatgaagattgatatgaagcagtggttcgatcaggtgacgctgaacgtgattttgatgatggtggtggggaagcggtgcgtgaccactggtgggaatgaagaggaggtgagagtggtgaaggtgttgcacgagtttttcaagcacctagggactttgtcggtatcggacgtggtgccgtacgtggagtggatggatctggacgggaatatagggaggatgaagagcacagccaaggaattagattgtatattagggagatggttggaagagcaccgccgtgagaggaggagtgatttcatggacgctatgttggcgatggtggaggggattaagataccttattatgacagcgacaccgttattaaagccatttgcctgaatctcctcaacgctggatccgatacccttggcatcacgatgacctgggcactgtcattactccttaacaaccgccacgtgttgaagaaagtcaaagatgagctggacgtccacgtgggcaaaaaccgacaagtggaagagttagacgtcaagaacttggtgtacctccacgctgtcgtcaaggaaacgctgcgcctcttccctcccgcgccacttggcgtgccacacgaggccatggaagactgtgtcgtgggaggcttccacgtggcaaaaggtacacgtctcgtcgtgaacgtgtggaagctgcatagagatcctagcgtctggtccgaccctctggcgttcaagcccgagaggttcttggacaacaacacggttgacgttagaggtcagcacttccagttattgccattcgggtcgggcaggcggggctgcccgggaatcacgttcgcgcttcaggtggcgcacctgacgctcgctcgattgctgcatggattcgagtgggacacaccggatggtgcgccggtggacatgagcgaggtctcggtattgaccacggcaaaaaagaaccctgttgaggttttgttcactcctcgtcttccggcagaggtctacacgcaaaattag

SEQ ID NO: 172 - DNA, 1572 bp, Menispermum canadense
taccaattattattccttcaaaccgccattgcaggcctactgttcgccttagcactactagtgcgccttcgcttctcgaggcgtaacaatggcaagaagaagcaagcaccaccagaaccagccggagcacggctcatcatgggccacatccacatgctcaacagtggcgagcagcctcacaagaccctcgctgcactggccgaccaatacggcccagtcatcaagctccgcctcggcctacgcgacgccatagtagtaagcaattgggagatggccaaggagtgtttcaccactaatgacaaaatcttccttagccgtccccagaccgtcgtgtcaaagttcatgagctacaacctcaaaatgctcggcttcgctccttacggcccgtactggcgtgagattcgcaagatagtggtgtctgagctgctctcgaaccgccggctcgagctgctgaagaacgcgtggacctctgagatcagctcgtgggtgaaagagttgtttgacgagtggggtgcgaaggaggcgagagggcctgttgtggtggacatgaggcattggttcgggaacttggcgttcaatatagggatgaatatggtggctgggaagaggttttttgggccgagagtggtgtctgacgaggacgggttgcggcgagtccagcaaggcctcacggatttctttaggctaataggcgcgttcttgttggaggatgcggtgccgtttctaagctggtgggacagtcaggggtatcagaaggagatgaaggacactgcgagagagatggatacactgattcaaggattgttggacgagcataaacgtaggagatcatcaagctctggtgaggccaaaggggagaaggacttcatggacgttatgcttaatattcttgaaggttcaaagttccccagtggagacgctgataatatcaacaagtctacttgcttgtctctaatgctcggcttgacggacacaacaacggcgaccctcacatgggctctctccttgctacttaacgacccgcgtgtcttaaagaaggctcgagaagagctggatttccacgtcggaaagaacagactggtggacacatcggacttaatgaacctcccatacatccacgccatagtcaaagaagtgttgcgtctccacccaccggcgcctctctccggccaccgtgaatccttggaggacagtgtggtgggcggctaccatgtccccaagggcacccgctttatggtgaacgtctggaagatccaccatgacccgaataagtggcccgaccctattgagttccgacccgagaggtttctgaccacccacaaagatgtggaagtgtggggccagaactttgaactgattccgttcagttcaggaagacgagtgtgtcccggggcttcgttgtctctacaagtgcttccgttcacactggctcgagtgttgcaagggttcgaagttgcaacaccaggaggtgcgccggtggatgtcacggagagcaaaggcctctcaactgctaaagagactccgcttgacgtcgtgatcactccgcgtctccctgaaaagttctaccattga

SEQ ID NO: 173 - DNA, 1587 bp, Nandina domestica
atggattcactcatttcatttcaagcaatagttgggcttttcatcttgatcctagtttcctatcaatggcttggaaggtctagaagtattaagactaacaagcataacgaagcaccggaaccagccggcagatggcccatcatcggtcatctacatttactcggagggtcggaccaattactctatcgaacgctagggtccatggccgataaacttgggccggcattcaatatccggcttggtagccgtcgggcctttgtcgttaacagttgggaggtggccaaggagtgtttcaccatcaatgacaaggcccttgctagtagacccatcactgtggctgcaaagctcatgggctataactatgcagtctttgggtttgcaccatacagcccattttggcgagcaatgcgaaaaatagccacacttgagcttctttctaatcgtaggctcgagatgctcaaacatgttcggatctcggaggtggacatgggcttgaaagaaatttatgggctttggtccaagaacaaggattcaggccctttaatgattgaactaaacaggtggtttgagaacttgactctaaatatggttgtgagaatggtggctggcaagagatattttggtgctgatgcatcatgtgatgagaacgaagcgcagcgctgccagaaggcaatcagtgaattcttccgtctcattgggatatttgtagtatccgacgcgattccttctctatggtggttggatttgcaggggcatgagaaggccatgaaaagaactgccaaggacctggattctatactaggaggctggttggagcagcatcggtcgcggagagtcaatggtaaggtcccaaccgagggggaacaagacttcatcgatgtgatgttatcgctacaagagggcgatcatctctctgattttgagtatgatgctgatattgccatcaaatcaacttgcctggcacttatcctaggtggcagtgacaccactgcaggtaccctaacttgggctatctcattgctactaaaccatccctatgctttgaaaaaagcccaagaggaattggacctccatgttggcaaggacagacaagtctatgatcaagacatcaagaatctggtatatcttcaagccatcatcaaagaaacactgcgcctatacccagctggtccactattgggcccaagggaggccatggaagactgcaccatatcagggttcgatgttcgagctgggacgcgcttggtggtaaatgtttggaagattcaacgagacccaaacgtgtggtcgaacccatctgagttttcacctgaacggtttttgacaagccatgtggatgtcgatgttaggggacaaaatttcgagctcatgccatttggatcaggccgacggtcttgtccaggcgcttcatttgccctccaggtcctgcatttgacattagcccgttttcttcatgggtttgggttggcaaacccattgggaaaacctgtagacatgaatgagagcccaggactaactatcccaaaagcaacacccctaaatgtgctgctcactccacgtcttgattcagagctatatggttgctag

SEQ ID NO: 174 - DNA, 1563 bp, Nandina domestica
atggaaacctttcagttccttggaattccattgtttggcttctttgccttattatgcacttactacctagtattgaggaagccatcatccactaagatcagggagccacctcggccagccggagcatggccaatcatcggccatctccatttacttgcccggggtgacctcccccacgtaactttggggaagatggctgataaatatggcccagtcttcaagttaaagcttggtgtccgacaagcaattgtggtaagtgattgggaggtcgcaaaggagtgttacaccaccaatgatcgtgccttagccaatcgtccaagtggcctaggagcaaaaatcatgggctacaactatgctttgattgggtctgccccctatggcccatattggcgtgatttacgcaaaattatcacgcttgaagttctctcgagccgtcggcttgaatcactcaagcatgtatgggactctgaaatatccacatctgtaaaagaattgtaccaaatatgggcagatcaaaacaaagctcaaggccaagtttctgttgaaatgaaacaatggtttagtgatatgacactaaatgtggcagttaggttggctgtcggaaagaagtacttaggtgcaactgccgattgtgaaaagaataaggcagtgcaatgtcaaaaggccatcaggaattttttcagactcgctggtttgtttgtggtggcagattaccttccatttctgggctggttggacttgggagggcacgaaaaagagatgaagcacacagcaaaagaactcgattatatagctcaagaatggttggatgatcataaaaagaagagaacctccaatcggacagtggacgagccacaggatttcatggatgtgatgctctcgatcttggaagaatcgactttcacgggttatgatgttgatatcatcaacaagtccacatgttttgcattgatcctaggtggaacagacactgtggcagttactctgacatgggctctctgtttattactgaacaatccacatgtactgaaaaaggcccaagatgagttggacatccacgtcggcaaggatcgacacgtcaatgaatcagatatcaagaacctcgtttacctccaagctatgatcaaggaaacattgcgcttatatccagctggtccgctactaggtccccgtcaggtcattgaggactgcaccatagctgggtaccacgtacgagcagggacacgtgtgatagtcaatgcttggaagtttcaacgagacccgtcgatctggtcaaacccttgtgagttccaaccggagagatttctggacaaagacatcgatgtgaagggtcaacacttcgaattgatccccttcggagcaggcagaagggcatgccccggaatctcctttgctcttcaagtattaccattggcattggctcgtttactacatggttttgagcttaaaaacccatcggaaagccaagtggatatgactgagacccccggtatggttcatgccaagacaacccctttggaagtacttatcacaccgcgcttgtctccaaaattttatgtataa

SEQ ID NO: 175 - DNA, 1488 bp, Nandina domestica
tggaagaggccaacctctgttaagtacagggaggcaccccaaccagctggcgcatggcctatcatcggtcatctccatttactggcccgtggagacctacaccacataactcttggagccatggccgacaagtacggcccagctttcatgatgcggcttggtgtgcaccaagcaatggtggtgagcgattcggagtctgcgaaggagtgttccaccaccaacgatagggtcttggccactcgaccaagtagcgtagctgtaaaacttatgggctacaactatgccatgtttgggttcggcccctatggatcatattggcgtgaaatacgtaaaatagttattcttgaggtcctgtcaaaccatcggcttgagtcactaaaacatgtatggaagtctgaaatatccatgtccaccaaagagttgtaccaattatggataaaccaaaacaaggatgaaggcccgactttggttgaattgaagcaatggctttgtaacatgacactaaatataggagttaggactgttgctgggaaaagatactttggcgcaagttcttgtgatgcaaatgaatcaaacaggattcaaagggcaatcagagatttctttagatttgtaggtttgtttgttgtgtcagattttcttccttttctagggtggttggacttggaaggttatcagaaggagatgaagagtattgctagggaacttgattctatccttcagggatggttggatgaacacacaaggaaaagacaatctggtgggaccaacgaaaatcaggattttatggacataatgctttcagttcttgaacattcgaatgcattgactcactatgatgcagatacaatcaacaaagcgacatgctttacaatgatcttaggtggaagtgatactacaatggtcactctaacatgggccctctccttgttactgaacaatccacatgtcttgaaaaaggcccaagatgaaatagatatccaagtaggcaaggacagacttgtggacgaatcagatatcaagaacctagtatacctccaagctatagtcaaggaaactttgcgtctgtacccagctgttccaataataactccacatgaggccatagaagactgcaccatagctgggtatcatgttccagcaggcacacgcctcattgtgaacgcttggaagatacaaagagacccattgatttgggataaccctggtgagttccaaccagagagatttctctacaaagatgtggatgtgaaaggtaaacatttcgaattaatccctttcgggtccggtagaagggtgtgccctgggatctcgttggccctccaagtggtgtcattggccatggcccatctcctacatgagttcgaccttgcgaaaccatcagaaggcaatgtggacatgactgagagtgttggtttggttaatgctaaggcaacccctttggaagtacttatcactccgcgcctatccccaaagttttatgaatag

SEQ ID NO: 176 - DNA, 1578 bp, Nigella sativa
atgggttccttcaaccaaataaatccatctgttgtatactttgctgcctttaccatcttcttcttcttctttctctataaaatattatacaagagaagaaccagtgcgaagaccagagttgctcctgaacctgctggtgcgtggcctttcataggtcacttacccttgctatcccagcaaaacttgccccatgtaacattgggggtgttggctgacaaatacggaccagctttcactgtccaactcggcttacacaaagctgttgtggtgagtagttgggaggttgcaaaggagtgcttcactgtcaatgacaaagtgctcgctactcgccctagctcagttgcagtgaagattatgtgctataactatgctgtgtttggctttggaccatatggttcctattggcgtgaagctcgcaagatagttgtacgggagcttctctcaaaccatcggcttaatttgctaaaacatgttctggtcactgaaattagcatgtctatgaatgaattgtacacagtttggcaaaagaatgctaataatgttagtggaaaagctttggtggagatgaagcaatggtttggtgacttgtcattgaacatgattgtcaagatagttgctggaaagcgatacttccaagctagtgcaaattcagatgaaagggatcagttgaaaaggggagtgcaagatctcttccatttggttgggctgtttctggtgtcagatgcacttccatttcttagctggttagacattggtgggcatgagaaagccatgaggagaactgccaaggagcttgacaacatactggggagttggttggatgaacataaacaggctaaattggcaggggcgacaaagggagagcaagactttatggatgtgttgatgtccatactagaggataacaataatctccctgagtatgaaccagatgttgtcagtaaagctatttgcttgggtatgattttgggtggagctgataccacaacaattactctgacgtggattgtgtccttactactcaacaatcaacacattttgaagaaagcccaagatgaaattgacagcaaagttggaaaagatagacaagtaaatgaatcagacatagaaaaactggtatacctccaagcaattgtgaaggagacattgcgtctgtacccacctgctcctctgtcaacacaacatgaagccatggaggactgcaccatagctgggtatcatgtccaagctggtacaagattgataacaaatatatggaagattcaaagagatccaggggtatggccgaatccttgcgagttccagccagagaggtttctcactacccatgccaatgtggagtcaaatggaaagcattttgagtttattccatttggatctggtcgacgggcgtgcccaggtatgtcacttgggcttcaggtggtgcacctgacattagcacgtctgctacaaggttttgaattggaaactccgttgagtgtggaagtagacatgactgaaagtgctggacttacaaatctcaaagtaacgccccttgaagttttaatcaatccgcgtctaccttcaaatctatactag

SEQ ID NO: 177 - DNA, 1554 bp, Nigella sativa
atggatttgacaagcatcttgatttgtatctttcttttcatcatttctatctgctttctgtcatggaagcgatcaaggagtctttccggaaccagagcagctccggaaccagttggtgcatggcctgtcataggccatctaaggctgctaatggggtccaaaacacctcatatgaccttaggaaacttggctgacaactatgggccggcattcaccatccggcttggtacgaagaaaacactggttgtaagtagctgggaggtggccaaggagtgtctcactaccaacgacaaagccttcgctggccgccacagcactatggcggtggagataatggggtacaactatgccttcttcagcttaggtcctagtggtcaatattggcgtgaaattcgcaaaataacagtttctgaacttctttcaaatcgtcggttggagttacttaaacacatatggagctcagagattaagacttctatcaaagaattgtatgaaatttgtgcagcacaaagtcaatatgggaaaaaacagtctcctatggtagaaatgcagcaatggtttagtcatttgaacttgaatttatcagcaagaatggttgttggaaaacgatattttgctgacggtgttgaagaaaatgaaggcgatatcagacgatttcaaaatgcaatcaaggagttcttttactgggctggagcgtttataatagctgatacaattccatatctaaggtggatggatttcttaaatgagcggtcaatgaaaagaacagcaaaagaaacagaccatgtacttgaaggatggttgcaggaacacaaacgaaacaggctgaacggtgtaacgaaggagcaagatttcatggatgtgctgctgacagaacttggtgacaaagatctgtgtggttacacagctgatgttgtgaacaaggccacttgcctgaacatgatttttggaggaacagataccacaaaaacgggcatgatatggactttatcattaattctcaacaatccacaagtactaaagaagttacaaaatgaaattgacatccaagttgggaaagacagacaggttgatgattctgacatagggaatctcgtgtacctacaagccactgtcaaggaagcgatgcgcctgtatccacctgctaccatatttggacgtgaatccatcgaggactgcactgtggctgggtaccacatccaagctgggacacgtttgattgtgaatgcatggaaaattcaaagagatccaaatgtatggcccaatcctgacgaatttcagcctgagagatttctgacaaaccaagcagatgtggacttcaggggtcaagattttgagctcattccttttggggctgggagaagggcgtgtcctggtatttcattgacagttcgggttacacatttgacactggcatgtttgctacaaggcttcaactttgaaacccccttgaatgaacctgtagatatgtccgagaaatatggtttaaccaactcaaaggcaacccctctgaatgttatactcacaccaagactcccttccaatttgtactag

SEQ ID NO: 178 - DNA, 1593 bp, Nigella sativa
atggattcaatatttcatatgtatgcaccaattaatatccttgctgctacctttgtttttattgtcatttctgtgtggtttctgttatggatgaagagatcgagaaagaatagcaagagcagaagagctcctgaaccggtagggggatggcccttgataggtcatttgcgcttgttagtcggccctgagttgccccatgtaatattgggaagcttggctgacaagtatggaccagctctctccatccggcttgggatgcgtcaagcattggtggtcagtaattgcgaggtagttaaagagtgtctcaccaccaatgacagatgcttctccactcgccctagctctgtcgcagtagagttaatgggatataactatgcgtcgtttggtttaggtccttacgggggcttctggcgtgaagttcgcaaaatcgcaattcttgagctcctctcaaatcatcgtttgaagtctcttaaacatgtatggatatctgagattagtggttttgtcaaagaactgtaccaattatgtgtagctaatggcaatacaggaaggcaatctgctttggtggaaatgcgacagtggttaaatgatttgacactaaatgtgtctgtcagaatggttgttggaaagcgatactttggctctggtagtgaacatggtggtgaagatgtcaagcggtttcaaaaggcaattaaagatttctttcgtttggcaggaaaattcacgctggcagatgcaataccattcctaaggtggttggactttggtcatgaaagagccatgaagaaaactgccaaagagttggactatgtacttgcaagatggttggatcaacatcaaaagaacaaactcaattgcgaaacaaagcaggtggatcaagatttcatggatgtcatgttgactgtccttggtgataaagatctgtatggtttcaaggctgatgttgtcaataaggccacttgccttaatttgatcttaggtggggttgacacgacgtcagtgaccctaacatgggcattgtcattgctactaaacaatccaaacattctaaacaaggcacaagaagaaattgatgtccagattggaaaagatagacaagttgatgacaatgacttgggaaaactagtgtacctagaggcaattgtaaaggaaacaatgcggttatatccagcaggtccactgtcaggtgcacgagctgcgatagaggactgcatggttgcgggatatcatgtaccaaaaggaacacgactgattgtgaatacatggaagatacagagagatccagagaaatgggacaaccctagtgagtttcggccggagagatttctgatcaccaccaccaatggccatgtggaagtgtggggtcaacattttgagtacattccttttggatcagggagaagaatttgtcctgccatctcattttcacttcagttggtgcatttgacattggcccgattgctacaagccttcagctttcaaacaccatcaaatgcagcagtagacatgactgagacccctggcctggtcaatttcaaagccaccccgctccaaattttactcactcctcgacttccttccagtttatactaa

SEQ ID NO: 179 - DNA, 1584 bp, Nigella sativa
atgctcagtattcatgattcaaccatggtttttctccaactacaagctatttgtggcatttttggcttcattttcattattacatggtggacaagatggaaaagttccaacaaaatgaaagcaccagaagtagctggtgcatggcctgtaattgggcacctgcatctgcttgggggcggccgtcccttataccagctccttggagacatgtctgataagtatggaccagcttttaccctccgaatgggaatccaaaaggcacttgtagtgagcagctgggaagttgcaaaagagtgtctaaccaccaatgacagagctcttgctacccgcccatcttcggctggagggaagtacatgggttacaacaacgcacttatccccttcagcccttatgggccatactggcgagacatgcgcaagattgctacacttgagcttttatctaatcatagactagaggagttgaagcatgtccgagaaatggaaatcaacacttgtatcagtgacatgtacaaactttgtcaggttgaggatggagttgaaattaaaccaatttctgtagatctgagtcaatggtttgcagatcttaccttcaatgtagtggtgatgatgataacaggaaagagatatattgggtcaactgatgcaggtgacatgaatgaaataagacattttcaggcagcactggttaaatttatgaggctattgagaatctctcttctggtagatgtatttccagttctacagtggattaattatgggggattcaaaggagtcatgaaatcaactgctagagatattgattccgtacttgaaaattggctgcaggagcatcagaggaaaagactttcccctgatttcaatggaaaccatgattttattgacgtgatgatatctaccttagaaggcacagaattctctgattatgaccacaatactatcataaaggcaatatccatggctatggtcgtgggcggcactgatactacaactacaacacttatatgggctatttcccttctattgaataatcctaatgcgatgaaaaaagttcaagaagagttggagatacatgtaggcaaggaaagaaacgtagacggatccgacatacaacatttggtatacctccaagctgttgtgaaggaaactctcaggctatatcctcccgttccactctcagtaatgcaccaggccatggaagactgtgttatcggaagttacaacattcaagcaggtacgcgtgtacttttcaatctctggaagctacaccgtgactcgtcagtgtggtctgatcctttagaatttcgaccagagagatttcttactagccatgttgatgtagacgtcaggggtcaacattttgaactgataccttttgggtctggaagaaggtcatgccctgggatttcatttgctcttcaggtcatacacttgacaatagctcgcttatttcatggattcaatctgacaacacctgggaattcatcagttgatatgagtgagatttctggagctacattatcaaaagttactccattagaagtactagttactccacggctgtcttccaagctttacaattga

SEQ ID NO: 180 - DNA, 1566 bp, Nigella sativa
atggatttcttgatctacgttgctgcctttgccgccgccttcttcttcttattgttctacaacatattatccaagagaataaccggtacaaagagaagaattgctcctgaacctgctggtgcatggccttttattggtcacttgcccatgctcttcgggcccaacttaccccatgtaacgttgggtgccttggctgacaagtatggaccagctttcactatccagctgggcttacacaaagctcttgtggtgagtagttgggaggttgccaaggactgcttcactgtcaatgacaaagccctcgccactcgccctacctctgctgcagtgaagattatggcctacaactgtgccgtgttcagtttctcaccatatggttcatactggcgtgaagcacgcaaaatagctatacttgagcttctttcacaccataggcttgatttgttaaaacatgttcggaaatctgaagtaagcacatctataagagaactgtaccaattttggcaaaaaaatgctacggaagttactaaatttgctcagctggaaatgaagcaatggtttggtgatttgacaatgaacctgattgtcaggatggttgctggaaaaagatatgctagtgttcaatcagatgatgatggtgaggggaaaaggctacaaaaggccgttaatgatttcttccatctagtagggttgtttgtggtatccgacgcacttcccttccttggttggttagatattgggggcaacttgaaaaccatgaagaaaactgccagggaacttgacagcataatggagtgttggttgaaggamcatcaagctcggagatcaaatggggagcaagatttcttggatgtgatgttgtccatactgcgtgaagataataagctgcaagagtatgatggtgatgttgttgtcaaagctatgtgcttgaatatgattttgggtggagctgatagcacaacaatcactctaacatggaccatctccttactacttaacaacagacacattttgcagaaagcccaagacgaaattgacagcaaagtggggaaagatagacaagtgaatgaatctgacatagagaaactagtataccttcaagcaattgtraaggagactttgcgtctgtacccacctgctcccctatcttcacaacatgaagccatagaggactgcacaatagctggctaccacatcccagctggtacaagattaataacaaatctatggaaaatccaacatgatccaagtgtatggcacaatccttccgagtttcagccagagaggttcctcactacccaggcgaatgtggactttagaggtcagaatttcgagtttattccatttggatttgggcgacggtcatgcccaggtacctcacttggtcttcaaatggtgcacctgccattagcacgtttgctacaaggctttacatttgaaacaccatcaaatgcagctgtggacatgactgaaagtgctgggcttacaaatcacaaagtaacaccacttgaggttctaatatcaccacgtctccgtttcgatctttatcaagaatctcccccttga

SEQ ID NO: 181 - DNA, 1580 bp, Nigella sativa
attccttcaaccaaacatatactggttttatctgcttatctgtctttgcctccttcttcttcttcttcctttacagcgtgcagcagaagaggagaacaggtagaaaggccagatacgctcctgaacctactggtgcatggcctttaataggtcacttgccaatcttgttcgaacctaacttaccccatatacagttgggagccttagctgacaagtatggaccagtgttctctatcaaacttggcttacggaaggctcttgtggtaagcagctgggaagttgtcaaggagtgcttcactgtcaaagacaaagtccttgcctcccgccctagctcagttgctgtgaagataatgggctatgattatgccgtatatgcattcggaccatatggatcatattggcgtgaagctcgcaagttaactatacttgaacttctctcagaccatcggcttgatttgctaaaacatgttcgggtctctgaagttagcatgtctatgaaagaactactcaaattctgccaaaagaatgccaataatgtcagtggaaaagctttattagtagatatgaagcaatggttcggtgacttgacattaaatgttattgttaggatggttgctggaaagagctacttgggtgctagtgcaaaattggaagacggcgaacagaaacggttacaaaacgcaattcatgagtttttccgtttggcggggctatttgtggtgtcagatgcacttccaattcttagctggttagacattggggggcatgagaaagccatgaggagaaatgccagggagattgacaagataatgagcagttggttggatgaacatcgacgcaataaattggccggggtaacaaatggagagcaagactttatggatgtattgttgtccaaatttgagaatagtaatctccctggatatgaacctgatgttgcaatcaaggctatttgcttgaatatgattttaggtgcagctgataccacaatcgtcactctaacatgggttgtgtctttaatacttaacaaccgccaaattttgaagaaggcacgagaggaaattgagaataaagttggaaaagataggcaagtgaatgaatctgatatagagaaactagtatacctccaagcaattgtgaaagagacgttgcgtttatacccagctgctcctctatcagcacaccatgaatccatggaggactgcaccattgctggctaccacgtcccagccggtacacaattaataacaaatttgtggaagatccaaagggatccacgagtatggcctaatccttgcgagttcctaccagagaggttcctcaccacgcatgcaaacgtaaactataagggtcagaattttgaattcattccatttggatatggtcgaaggtcgtgcccaggtatgtcatttggacttcaaatggtgcacttagtattggcatctcttctacaaggctttgaattggaaactccattgaatgaggcggtagacatgactgagagcgctggacttacaaatctcaaagcaacgcctcttgaagttctaattactccacgtatgcctttgaatctatactga

SEQ ID NO: 182 - DNA, 1530 bp, Nigella sativa
gtaactgttatctacttatttacatttgccatcttcttctacctctacagcatattatggaagaacccaagaaagagtgcaaagaccagagttgctcctgaaccagctggtgcatggcctttcatgggtcacttgcctatgctattggaacccaacttgccccatataaagttgggagccttagctgacaagtacggaccagccttcactgtccaactcggcctccacaaggctctagtggtgagcagttgggaggttgccaaggagtgcttcactgtcaatgacaaagtcctcgcagatcgccctagctcagttgcagtgaagataatgggctatgataatgctgttttcgcctttggaccatatggttcttactggcgtgaagctcgaaagatatctacagttgagcttctctcgaaccatcgtcttagtttactgcaacactttcgaatttccgaagctagcatgtctatgaaggagctatatcaactttgtgccaataacgggaaggctttggtggaaatgaagaaatggtttggtgacttgtcattgaatgtaattgtcaggatggttgccggaaagaggtatgccaaagctagtgaagatgatgaacggagacagttacagaaggggcttaaagatttcttttatttggtaggattgtttgtagtgtcggatgcacttccaattctaagttggttagacattgggggccatgagaaagccatgaggagaaccgccaaggagcttgacaccataatggagaggtggttagatgaacatagacgggctaaattggctggggtgacaaagggagaacaagacttcatggatgtgttgttgtccatacttgaagatggcaagcttcctcactatgaatctaatacagttaacaaagctatttgcttgactatgattttgggtgcagctcataccacaacagtcactctaatttggacattatcgttactacttaacaatcgacatattttaaacaaggctcaagatgaaattgattccgaagttgggaaggatagagcagtgactgaatctgatataaagaatctagtatacctccaagcaattgtgaaggagacgttgcgtttatatcctgctgcacctctacctgcccaccgtgaagtcatggaggactgcatcatagctggttaccacgttccagttggtacaagaataataacaaatttatggaagattcaacgagatcctcgtgtatggtctaatccttgtgccttccaaccagagaggtttcttactactcattcaaatgtggactttaggggtcagaattttgagttcattccatttggatctggtcgaagatcatgcccaggtatctcacttgggcttcaaatggtgcacttggcattagcgcgtctgctgcaaggatttgagttagaaactcctttgaatctgggaatagacatgactgaaagttctggacttacaaatcttaaagtaacaccgcttgaagttgtgatcacaccacgactaccttcaaatctatactga

SEQ ID NO: 183 - DNA, 1689 bp, Papaver bracteatum
atggcgtatttgatgatcaagaaatctttccacttgttttccgatcaaccaacttcagtttccactcttatagtacttgcttttctactgacactttcacctgttattatttactatgaacagaagaagaggggtttgaggcgaaatcggacctcatcgtcatgtaccgcaattacaacgactccgttaccagaggcatcaggtgcgtggccagtgataggtcatcttcttcttttcatgaacgaaaacgatttaaatcatgcaactctcggtaacatggctgataaatatggacctattttcagcttaagattcggtagtcatagaactctagttgttagtagttgggagatggtaaaggagtgttttacaggtgccaatgacaagtttttttcaaatcgtccttcctccttggcggttaaacttatgttttatgacactgagtcttatggctttgcaccgtatgggaagtactggagagagttgcggaagatatctacacataaactcctctctaatcagcaattagacaagttcaaacacttgcggatttctgaagtggacaactcctttaaaaagcttcacgacttatgcagcaacaacaaactgggaggagaaactacatctgtggctaatcttgtgagaatggatgattggttcgcttacttgacattcaacgtaataggacggattgtcagcggattccaatcaaatgcagtgtcaggtgccacaagcagccaggaaaaatacaagcttgcaatcgatgaagtgtcaaatcttatggcaacatttgccgtttcagatgtggttccatgccttgggtggattgaccgattgactggtcttacaggaaagatgaagaaatgcggaaagaaattagatgcagtagttggggatgcagtggaggttcatcgccaaaagaaactcaaaatttctagaaataccgcaggagaacttacggagcatgaagaagaagacttcatcgatgtttgcttgtcgattatggagcaatcacagattccgggaaacaaccccgaaatctctgtcaaatctattgccttggacatgttatcgggtgggagtgacactacaaagttgataatgacatggaccctttctttgctgttgaaccatccagacatattggacaaggctaaagaagaagtagatacatacttcaggaagaaaaagatatcggataacacacctgtggttgatgctgccgatgttcctaacctcgtctacatccaagctatcatcaaagaatcaatgcggttataccccgccagcacattgatggagcggatgaccagtgatgattgtgaggttggtggcttccacgttccagctggaacccgactatgggttaacgtatggaagatgcaacgagacccaagggtttggaatgatccattggtatttcgacctgagagattcttgagcaatgacaaagggatggtagatgtgaagggtcagaattatgaactgataccattcggaacaggcaggcggatatgtcccggtgcatcttttgccttagaagtcttgcatttggtcctcactcgtcttattcttgagttcgagatgaaggcaccagagggggaaattgacatgagggcaagaccaggttttttcaacaacaaggtagtgccactagatgttctactcaccccacgcacactagattaa

SEQ ID NO: 184 - DNA, 2561 bp, Papaver bracteatum
atgaataactactcatcatcacctgcatcatcaacagaaacagcggtactttgtcatcagcggcagcagtcgtgtgcattgccaatttccggtcttcttcacattttcatgaataaaaacggcttaattcatgtaactcttggaaatatggcggataaatacggaccgattttcagtttcccaacaggtagccatagaattctcgttgtgagcagttgggagatggtaaaagagtgttttacaggcaacaatgacactgctttctcaaaccgtcctatcccgttagcttttaagactatattctatgcatgccgtggcatagactcatacggtctttcgagtgtaccttatggaaaatattggagggagctacgaaaggtctgtgtgcataacctcctctctaatcaacaactactcaagttcagacacttgataatttctcaagtcgatacgtctttcaataagctgtatgagttatgcaaaaactctgaagacaaccagggaatggtgagaatggatgattggctcgcccaattatcgttcagtgtgataggaagaatagtctgcggattccaatcagaccctaagacaggtgctccaagcagggtggaacaatttaaagaagcaattaatgaagcatcttattttatgtcgacatctccagtgtcagataacgttccgatgctagggtggattgaccaattgactggtcttacgagaaatatgacgcactgcggaaagaaattagacttggtggtagagagcataattaatgatcatcgtcaaaagagacgattctctagaactaaaggaggagatgagaaggacgatgaacaagatgacttcatcgacatttgcttgtcaataatggagcaaccacagcttcctggcaacaataaccctcctaagatacctatcaaatctattgtcctggacatgataggtgcggggactgacaccacaaaactgaccatcatttggaccctttccttgctgctgaacaaccccaatgtgttggccaaggcaaaacaagaagtggatgcacactttgaaacgaaaaagagatcaacaaacgaagcatcagtcgtggtggatttcgatgatattgggaaccttgtctacatccaggcaatcatcaaagaatcaatgaggttgtatccggtcagcccagttgtggagcgactgagcagcgaagattgtgtggtcggtgggtttcatgtaccagcagggacgagattatgggctaacgtatggaagatgcaacgagaccctaaagtatgggatgatccattggtgtttcgaccagagagatttttgagcgatgaacagaagatggttgatgtaaggggtcaaaattatgagctgttaccatttggagccggtcgacgtatatgtccaggtgtatccttctctctggatctaatgcaactggttctgactcgtcttattcttgagtttgaaatgaagtctcctagcgggaaagtggacatgacagcaacaccaggattaatgagttacaaggtggtccctcttgacattctgctcacccatcgtcgcataaagtcgtgtgtgcagttagcatcctctgagagagacatggagagtagtggtgtaccagtaatcactctgagatcgggcaaggtgatgcctgttttaggcatgggaacatttgagaaagctggtaaagggtctgaaagagagaggttggcgatattaaaagcgatagaggtgggttacagatacttcgacacagctgctgcatacgaaactgaagaggttcttggagaagctattgctgaagcacttcaacttggcctaatcaaatctcgagatgaacttttcatcagttccatgctctggtgcactgatgctcaccctgatcgtgtcctcctcgctcttcagaattctctgaggaatcttaaattggagtatgtggatctatatatgttacccttcccggcaagcttgaagccagggaagataacgatggacataccagaggaagatatttgtccaatggactacaggtctgtatggtcagccatggaagagtgtcaaaaccttggcctcactaaatcaatcggtgttagcaatttctcctgcaaaaaacttgaggaattgatggcgaccgccaacatccctccagccgtgaatcaagtggagatgagcccggctttccaacaaaagaagctgagagagtattgcaacgcaaataatatattagtcagcgcagtctctatactgggatcaaacggaaccccatggggctccaatgcagttttgggttctgaggtgcttaagaaaattgctatggccaaaggaaaatctgttgctcaggttagtatgagatgggtttacgagcaaggcgcgagtcttgtggtaaaaagtttcagtgaagagagattgagggaaaacttgaacatattcgactggcaactcaccaaggaagacaatgaaaagatcggtgagattccacagtgcagaatcttgagtgcttattttttggtctcacctaaagggcctttcaaatctcaagaagagttgtgggatgacaaagcttg

SEQ ID NO: 185 - DNA, 1623 bp, Papaver bracteatum
atggagttcttgatgaagttattattgttacttgaaccaatcacttttagtatttttcttggtataggttctattgttcttctatacaatgtcttcttcttggttattaacaagaaaaagaagaagaaagcaccaaatgcatcaggggcatggccgttgataggccatctcaatcttttcatgaatgataaggaagcgttgtataaaacactaggaaccatggccgacaagtacggacctgcattcaacgttcgattaggcaaccaagaaatccttgtggtgagtaattggaagatggtaaaagaatgttttaacactcaaaatgataagctattttcgaatcgtcgaactacattgggtgtgaaatacatgcttaacaagaagacctctgttgccttttcaccatatggaacatattggagggagctacgaaagctaacggtgcaacaattgctctctaagcaacgtttagattcgtggaaacatttgaaaatcaaagaaatagatgcttcatttggtagacttaacgatttatgcagcaacaacaagggtactggagcagctaccccaattaggatggacagttggtttgccgagttgacgttcaacgtgttcgcaagaattgtctttggctaccaaagtggagaaaggttgatgctatcaggtgatacggcatccaacggggagaggtacaagaaaacattagaagaagcatttctccttatgtcaagctttgcggtttctgacgtattcccatgcttagagtgggtagacagatcaagaggccttgtaaggagcatgaaacgctttggagatcagctaaattcaattgcagggtgtcttattgaggagcatcgccaaaagagatcacaatccgtatcagcatcaaattctacaaatgataaaggagttggtgatgaacaagacttcattgatgttctcttatcggttgctgaactatcacaaattcctggagatgaccctgatttggtcatcaagtctatgattttggaagccttagcaggtgggagtgacacaacaacatcaaccctaacttgggttctttcactgctattgaaccaccccaaagtgttaaagacggcaaaagaggaaatagatatgcacgtcggacgtaatcgatgcgtagaagagtcagatattcccaagctcgtttatgtcaatgcaattatcaaagaatcaatgagattgtatccaaatgggtcattggttgatcgattgacgttggaagagtgtgaagttggtggattccatgtcccagctgagggacacttattcgtaaacgtttggaagatccatagagatccgagtgtgtgggagaatcctctggagttcaagccagagagatttttgagtaatgattgcaaggtggatatggatttcataagtcaaaaatatgaattcataccattcgggataggtcggaggatatgtcctggtatgctttcagcattacaggtgatgcattttgtggtagcccgtcttattcatgggtttgatatggaagcagcaagtgccgatgggaaagtggatatggcagaaaagccaggcatgacttgctataagatgacacctcttgaagttatgctcacggctcgacagtag

SEQ ID NO: 186 - DNA, 1647 bp, Papaver bracteatum
atgtatccggtaaaccagttgcagagtcaagcaattgctgtgctatgtgccgtaattgtcttcatcttctatttggggagaaagttgtttaacagtacccatattcataagcctggaaagacagcaccagaaccagcaggcgcatggccgattataggtcatcttcacctccttgggggagcaaaactcatgtaccgaaccctaggttctttggcggacgaatacggaccagttttcatggttcgacttggtatgcgacgggttcttgtaattagtaacacggcgtcagctagagagtgtttcactacaaatgataaggtttttgctacccgcccaaccacagttgctataaagttgctgacttacaatcacaccatgtttggttttgcaccttatggaccttactggcgcgagatacgcaagatagcaacaacggagctcctatcggatagacgtctagccatgctcaaaaacgtgtggatctctgagattaatttgtgcataaatgaattacatcaactcttgatggacaagaatagtagaaaagtagatcatcatcaacatgtttacaaccaaaatatggacccaatttcggtggagatgaacggatggtttgcagatttgtctttcaatgttgtggccagaatgatagctgggaaaagatatttcggaaagaacaccgatggtggcgaagaagaaaccaggaggtatcgggaagcaatgaatgattttatgcacttggtagtgatattattggtgtctgatgctgttccatttttagggggtttagacttccagggatataagaaaaggatgaagaaaactgccaaggaaattgattattttctgggtaaatgggttgatgaacatcgacagcgtttgaaatataaaaacatatccaaggttgatcaacaagatgatttcattgatgtgttactgctgaatttaaatgatcaaccgatctatggtcgcgatactgatacaatcatcaagtctacttgcctgtctcttatcgcaggtggtagtgacaccacagcagttaccctaacttgggcactatcgttactgctgaacaaccaacacgtgttaagaaaggctcaggacgagttggacatacacgtaggcagggaaagacaactggaagaatcagatatcaagaacctcgtttatctccaggccatagtgaaggaaacattgcgtttatatccagctgcaccgttatcagcaccaaggatggcaatggaagattgtacggttgcgggattccaagttagtaaaggcacacagctgatgcttaatgtatggaaactacatcgagacccgcatttttggggacctgatcctctggagtttaggccagagagatttcttactgctgatggtagtagcacgggaagtggtcattgcattgatattgatgttaagggtcggcattatgagttactaccatttggatctggtagacggatgtgcccaggagtttcatttgccatgcaagtcgttcatctgacgctcgctactttacttcacggatttcatttatcgacgccaacagatggtccagttgatatgactgaaacttcaggacttagttgccccaaagcaaccccattagaagttttgctcactccacgtctgccctgttag

SEQ ID NO: 187 - DNA, 1704 bp, Papaver bracteatum
atggatgtggcaatcatcgtcgatcaccactacttgcagccgttcgtgagtattgcaggcttattagctttgctatccttcttctattgtatttgggtctttattataaggccaaggattatcaaaagcaacttagacgagcgcaaattatcaccatcatctccacctgaagttgcaggtgcatggccgatagtagggcatcttcctcagctaataggatctacacctctattcaagatccttgcggatatgtctaacaagtacggacctattttcatggtcagatttggtatgtatccgaccctagtagtgagcagttgggagatgtcaaaagaatgcttcactaccaacgataggttattcgctactcgtccacctagtgcggccggaaagtacctcactaaagccttgtttgccttttctgtgtatggtccttactggcgggagatccgtaagatctctacaatccatttactctcacttaggcgcctcgagttacttaagcatggacggtacttagagatcgacaaatgcatgaaaagattatttgaatattggatggaacatcataagaacatcataagcacaactagttcagttaaggtcaacatgagccaagtgtttgcagaactatccttaaatgtggttttgaagataatagttggaaagaccctttttattaaaaatggtaatgaagattacaccaaagaggaagaagaaggccaaaagctccacaagactatcctaaaattcatggaactagcgggggtatcagttgcatctgatgttcttccattccttgggtggttggatgtggatgggcaaaagaaacaaatgaagagggtctacaaggagatgaacttgattgcttcaaagtggcttggagaacatcgagagagaaaaagactgcaaataatacaaaaacgcggagcagcaagaggcagtaattatgatgatgggaatgacttcatggatgtgttgatgtcaattcttgatgaagaaaacgatgatctcttctttggttacagtcgagatactgtcatcaaatctacatgtctgcaacttatagtggccgcttcggatacaacgtcacttgcaatgacatgggctctctcactgctgctcaccaatcctaatgtcttacagaaggctcaggatgagcttgataccaaagttggcagggacagaataatagaggaacacgatatcgagtgtctcgtctacctccaagcaattgtcaaggaaacactccgattgtaccctcccgctccactctccctaccccatgaggctatggaagactgcactgttggtgggtaccaagtgaaagcaggcacacgcttagtagttaacctgtggaaactgcagcgtgatcctcgagtgtggtcaaacccgttggagtttaagccagagaggtttcttccacagtcagatggtggttttggtggtgaagaagcaagaatggacttcaggggacaacattttgagtacacgccatttggatcagggagaaggatatgcccaggtatcgactttttcctccagacagttcacatggcactagctcgtcttcttcaggcatttgatttcaacacagctggaggactagttatagacatggtggaaggtccaggtctaaccatgcccaaagtaaccccacttgaagttcacctaaacccacgtctgccggtcacactttactag

SEQ ID NO: 188 - DNA, 1677 bp, Papaver bracteatum
atgcaggtggattggccaaacatcttacagaagtactacccaataataacatgttcattattaactttgctatccttctattatatatgggtctccatcacaaaaccaagcaggaattcaaaaaccaaattaccgccacctgaagttgcaggttcatggcctatagtaggtcatcttccacagctagtaggatctacacctttgttcaaaatccttgctaacatgtctgacaaatatggacctatcttcatggtccggtttggtatgcacccaaccttagttgtgagtagttgggagatgtctaaggaatgcttcaccaccaatgacaagttcctcgccagtcgtccacctagtgcttcagccaagtacctcggttatgataacgccatgtttgttttctcagattatggtccttattggcgtgagatacggaagatctctactctccaattactcacacacaagagactcgattcgctgaagaatatcccttacttagagatcaacagctgcgtgaaaacgttatatacccgttgggcgaaaacccaaagccagataaagcaaaatgttggaggtgcagctgacgattttgttaaagtcgacatgacagaaatgtttggacatctaaacttaaatgtggtgttgaggcttgttgtaggaaagcctatttttatccagaaagacaatgctgatgaagactacacaaaggatggccataacaaagaggaattaggtcaaaagcttcacaagactatcatagagttctttgaattagcaggtgcttcagtcgcatctgatgttcttccatatcttgggtggcttgatgtagatggacaaaagaaacgcatgaagaagatagccatggagatggacttatttgctcaaaaatggcttgaagagcaccgacaaaaaggaatcaatcatgataatgagaatgacttcatggccgtgttgatatcagttcttggtgaaggaaaggatgaccacatcttcggttacagtcgggacactgtcataaaagccacatgtttgacacttatcgtagcggctacagacaccactttagtgtcattgacatgggctctctcactactactcaccaatcctagagtcttaagcaaggcgcaagatgagcttgacacagtagtcggcaaggaacgaaacgtagaagatcgagacgtcaatcacctggtctacctccaagcagtcatcaaggaaactctccggttgtaccctcctagcccactcgccgtaccccatgaggctattgaaaactgtaatgtgggcgggtatgaagtgaaagcaaggacacgtttattggttaacttgtggaaaattcatcgtgatcctagagtatggtcaaacccgttggagtttaagccagaaaggtttctcccaaaactggatggaggtactggtgaagcttctaagttggacttcaaaggtcaagattttgtgtatacaccattcggttcgggacgaaggatgtgcccagggatcaactttgccagtcagacgcttcacatgacgctagctcgcctactccatgcattcgattttgacattgagtcaaatggactagtaatagacatgacggaaggttcaggtttaaccatgcccaaagtaaccccactccaagttcaccttcgcccacgtctccctgccacactttactag

SEQ ID NO: 189 - DNA, 1716 bp, Papaver bracteatum
atgatggatctagcaatgttcatcgatcaatacttctcattagctaaaattgcaggcttattagctttgttatctttcttctattatctatggatctcaactttgtggtcgccaaggaatcccaaactatcatcagtatcaccacctgaagttgctggtgcatggcctatattaggccatcttcctcagctactaggatcaagacctctattcaaaatcctagcagacatgtctgacaattatggtccgatcttcatggtccggtttggtatgcatccgaccttggtggtaagcagttgggagatggctaaagagtgcttcaccaccaacgacaggttcctcgctggccgcccatcgggtgctgccaacaagtacctcacgttcgccctgtttgggttttccacatacggcccttactggcgagagatccgtaagatcgctaccctccatttactctcacataggcgtctcgagcttctcaagcatgttcctgacttggaggtcaccaactgcatgaaacacttgcatcgacgctggatagacagtcaaaaccaaataaaacaaaatgacgctgcagctggttcagtaaaagttgacatgggcagagtatttggcgagctaaccttgaatgtggtgttgaagttagttgctggaaaatcaatttttttcaagaacgacaacactcgtcaatatgactccaaggatggtcataacaaagaggaggaagaaggtaaaaagctccataagaccatcatagatttctactcattagcaggagcttcggttgcatctgatgttcttccatttcttgggtggttggatgtggatggacaaaagaaacgcatgaaaagggtagccaaggatatggatttcatcgctgcaaagtggcttgaagagcaccggcatcaaaaaagacaaacagtactatcaagctcagcaacactaggcagcagtaatcatgacgatgcgaaagatttcatggacgtgttgatgtcaattcttgatggggaaaatgatgatctcttctttggttacagccgtgacactgtaatcaaaaccacatgtctgcaacttatagcagctgccgcagataccacatcagttacgatgacatgggctctcgcactactaattactaatccgaccatattaagaaaggctcaggatgagcttgataccaaagtaggcaaggacagaaacatagaggaacgcgacatcaatgatcttgtctacctccaagcaattgttaaggagacactccggatgtaccctgctggcccactcaacgtaccccacgaggctatcgcagactgcaatattggtgggtatgaagtgagagcaggcacccgtttgttggtaaacctatggaaaatgcaccgcgatcctcgagtatggtcaaatccgtcagagttcaagccagagaggttccttccacaactggatggtggatctggtggtgaggcggcaaacttggacttcaggggtcaagactttgagtatctaccttttagtgcaggaaggaggatgtgtccagggatcgacttttccctccaaacgcttcatatgactcttgcgcgcctgcttcatgggttcgatttcaacaatgactcggcaggaataataatagacatggaggaaggttcaggtttaactatgcccaagttaacaccactagagatttacctctgcccacgccttccagccaaactctactag

SEQ ID NO: 190 - DNA, 1632 bp, Sanguinaria canadensis
atggagtttctttctctacaattccaaccgattaccatttttgcccttcttcttgccactcccatttttctgtacaatctctggaattatggaaggaaactcaacaacaagaacaagaagagcagaaaaccaccagcacctgaagcatcaggtggatggccgatcatgggtcattttcatcttttcaatggaaccgaggtgactcaccgagctctcggttccatggcggacaaatacggtccagctttcaatatccgaatcggttctcatccaacacttgttgtgagtagttgggagatcgctaaggaatgtttcaccacaaacgaccgactcttctcaaataggccaggttctttagcgattaaactcatgttctacgatgccgattcggttggttatgcaccgtacggaacttactggagagagttgagaaagatttcaactctaaaacttctttcaaatcacagattggaaacgcttaaacatttgagaacatctgaagttgaatcctgttttaagcagcttcatgatttgtggcggatgaacaataaaaagggggggagcgatgatggatcagattttgctctggtgaggatagataattggtttggtgatttgacttttaatgttgtggcgagaattgttgccgggaaaaagaattttgcgggaggtgcggcgagtggtgatgccggagctcaaagatataaggaagccatggatgaagcgtttcgtttgatgacgaggtttgcgttctcagatgttgttccatcgcttggatggttagataaattgacaggacttgttggaggaatgaaacgttgtggatctgaaattgattcgatcgttgcaagttgggtggatgaacatcggttgaaaagaatttctggaaaagaaggggatgatcttgaacaggatttcatcgatgtttgcttagagattttggagcattctactttgcctggcgatgatcctgaagttgtcatcaaatctacttgcctggacatgatattgggtgggagtgacaccacaacagtgaccctaacatgggccctctccttactattggaccatccccacgtgtggaaaagggcgaaggaggaagtggatgcacacgtgggaaaggagagacaggtggaggactcagatatccctaatcttgtgttcatccaagcaatcgtcaaagagacgatgagattgtacccagctggaccactgatcgagcggaggacaatggatgattgtgaggtaggtgggttccacataccaggtggcacacgtttaattgtgaatttatggaagattcaaagagacgggagcgtgtacaaggaggatccattggagtttagaccagagaggttcctgacgagcaacgcggaggtggatctaaagggacagaattacgaactgataccatttggtgctggaaggaggatatgtcctggagtgtcgttcgcagtgcaattgatgcatttggtactggctcgtctcattcacgacttcgaaataacgatgcccatgggtgcgaaagtagacatgactgagagtggaggactaatcagccacaaggtgacgccgctggaagtgctgctcaaaccacgcctcccctcgctccaacaagcagctttatattaa

SEQ ID NO: 191 - DNA, 1578 bp, Sanguinaria canadensis
atggaatattcctcagtacttctccattggttccctgcttccatggctgcccttcttgccttggtttttctgtacaatctcatctttaattccccaaaaaccggtaataagaagattataaggagggcacccaaagcagccggtgcatggccagtccttggtcacctccatttgtttggatcaggtgagctgcctcacaaaatgctcgcagccatggcagaaaaatacggccccgccttcacaatgaaattcggtaagcacacgacactagttgtgagtgacacccgcgtcgtaaaagaatgtttcaccaccaatgacaccctctttgccaaccgtccatccaccaaagcctttgatctcatgacttacgccaacgactcggtagccttcacaccttacagtccttattggcgcgagcttagaaagatatccactctcaaacttctctctaaccaccgcctccaatcgatcaaggaagtccgagtctccgaggtgagcgtatgttttagggagctatacgatatatgcaaaaatgatggaggaggagctcctccagttttggtggatatgaagaaatggttcgaagaggtctcgaacaacatagtgatgagggtaatcgtagggaaacaaaattttgggtcgaagattgtttgtggcgaagaggaagccgtcaattacaagaacgtcatggatgagctcctacgtcttgctagtgtgtctatgttatcggatgtggcacctttacttggttggttggatatgttccaaggacacatgagcgccatgagacgaaatgggaaaaaactagacaccatacttgagaggtggttggaggagcatcggaagaagaagagtgaggatgagcaagatttcatggatgttatgttgtcgatcgttgaggagactaagttgtctggccgcgacgctgataccgtcattaaagctacttgtctggccatgatcatgggtgggacagacaccacggctgtgagtctaacatggatcgtttccttattgatgaacaatcgctatgcattgaaaaaggctcgagaagaattggacgcgctcgtggggaaagatagacaagttgaagattcagatttgaagaatttggtgtacttgaatgccgtcgtcaaggaaacgatgcgattatacccgttgggtactcttcttgaacgtgacaccaaagaagattgtgaggttggtgggttccatgtggaaggcggtacgcgtttactagtgaatgtatggaagttacaacgagacccaaacgtgtggaatgatccattagaatttagaccagagagatttctaacagagaatgcggatatagatgtcggaggccaacatttcgaattactaccatttggggcagggagaagggtgtgcccaggagtgtcgttcgcactccaattcatgcatttggtattggctcgtctcatccatggctatgaattgggaacccaaaatgatgaggatgtggatctaactgagagcacagaaggacatgttaaccacaaagcctccccgctcgatctcctcatcaccccacgcctccaccctaaactttatgaataa

SEQ ID NO: 192 - DNA, 1584 bp, Sanguinaria canadensis
atggattattcatcccatttgaaccagttctacggggtagctccatacatggctgccctactaattgccttagtgtttctctacaatattctttgggcttccccaaaaaccaccaacaagaaaccaatcatggcagccggggcatggccaattctaggccacctccatctgtttaaagatggggaattgcctcaccacatgcttaaatccatgtctgataaatacggccctgccttcctcatgaagttcggccaacaccgaacactcgttgtgagcaactaccgcatggtaaaagaatgtttcactactaatgacacccacttttgcaaccgtccatccaccacagccttcgatgtcatgacttacgctaatgactccgtcgctttcacagcttacagcccttactggcgtgagcttagaaagatttccactctcaaacttctctctaacaaccgtctccaggccatcaagaacctccgagaagccgaggtgaacgtatctttcagggggttgtatgatttatggaagaataatagtgatcgagctgcgtcggttttggtcgatatgaagaaatggtttgaagaggtctcaaacaacgtcgtgattagggtgatcgtggggaaacataattttgggactaagattgtgaagggtgagaaggaggctgtggaatacaagacgatcatggatgagctcttacgtcttgctagtttgtctttgttatctgattttgctcctatacttggttgggtggacttctttcaaggaaacgttcgaaaaatgaaacgaaatggcaagaaactagacgtggtacttcagaggtggttggagacgcatcggaggaagaagaactcaccagaggatgaacaagacttcatggatgttatgttgtcgatcgttgaggagggcgacaagttgtctggccaccacgctgatactgtcattaaagctacttgcttggccatgataatgggtgggacagacacgtccgcagtgagtctaacatggatcgtctccttactgatgaacaatcgtcatgcattgaaaaaggctcgtgaagaattggatatgtacgttgggaaggataggcaagtagaggattcagatttaaaggacttggtttacttgcatgcaatcgttaaagaaaccatgcgactgtacccactgggtactcttcttgaacgcgagaccaaagaagattgtaaggttggtgggttccacgtcgaagccggtacgcgtttactagtgaacatatggatggtacaacgagacccaaccgtgtggagtgatccaacaaaatttataccagagaggtttctaacagagaaggcggacatagatgttgggggtcagcatttcgaactcataccattcggggccggtagacgggtgtgccctgccgtgtcctttgcactccaatttcttcacttgatactggctcgtctcatccatggatatgaattaggaaccccaaatgacgcggatgtcgacttaaccgagagcccggaaggacatgttaaccacaaagcatcccctctcgaactcctcctcaccccacgcctcgaccctaagctctatatatga

SEQ ID NO: 193 - DNA, 1608 bp, Sanguinaria canadensis
atgaattcaatcgcagtcgtcggtgttcttcttttcttcctctactatctatggaggacactattcaccactcacaaagcggcgccaccaccacaaccagccggagcaaggcctattataggtcacctacatctcctcggtggagcgaatcaactagtccatcaaacactcggttccatggcagacaagtacggatcaattttcatgatccgactcgggatgcgacgagtcctcgtggtgagtagctccgagttagctaaagaatgtttcactacgaacgacaaggttttcctcaaccgcccaagttcattagctttaaagctgatggcctacaacaacgccatctttggttttgcaccttttggtccttactggcgtaagatgcgcaagatagcagtcaccgaacttctatccaacagacgcctcgagatactaaaaaacatcaggatctccgagatcaacatgtctataaaagaattacatcaactatgggtagatatgaacagtggtgatgatcaagtggggggcccaccaattgtggtggaaatgagaaagtggtttggggatttatcgttcaacgtggtgggtagaatgatagctgggaaaagatattttgggaggaattgtgattgtgatgaagaagaaacgaggaggtatcagaaggcgatgggtgattttatgcatttagtgggggtttttgtggtgtcggatgcgattccgttattagggtttttggatttacagggatatgagaagaagatgaaaaggacggccatggacattgattgtgttttagggagatgggttgatgaacatcgacgacgacgacaagaccacgatgagaagaggattatggtctccgatgatgatcatcaaggacaagatttcattgatgtgatgctatcgatcttaaatgatgatgatcagttctacggttacgatgctgatacagttatcaagtctacctgcctgtctcttatcgcaggcggccacgagaccacggcggtcacactaacatgggccctctctttactactaaacaatcgacacgtgttacaaaacgcgcaagatgagttggacatccacatcagcaaggaaagacaagtggacgaatcagatatcaagaacctgaaatacctccaagccatagtcaaggaagcattgcgtttatacccagctttaccactttcagcactaagattggccatggaggactgcaccatagctggatttcatgtccctaaaggcacagaattgatgcttaatctatggaaattacatcgagaccctcacgtttggtctgaccctttggagttcaagccagaaaggtttcttactaatagcacccatgaagaagttgacgttgggggtcaacattacgaattactaccatttgggtctggtagacggatgtgccctggggtatcgtttgctcttcaagtcctgcacttgacgcttgctcgtctacttcatggatttcatttgtcgactccgtccggtgtacctgtggatatgactcaaagttttggccttagttgcccaaaagcaactcccttggatgtcctccttacaccacgtctcccttcaaagctatattatgtagcataa

SEQ ID NO: 194 - DNA, 1806 bp, Sanguinaria canadensis
atgatttcaactacgccggacgtactagctacctcatcatattcatcatctaacaagcatatggattcagatcatctttaccggttctcaactagtactagtatagttattggcctctttattttactattcttccttgtgctcctatggaaaccaaagaagcagtctgctacttctaagactaacaaaccaactagagagcagcgggcaccggaaccttctagttcatggcccataatcggtcatctccgtctcttcggaggaccaaatagccttccccacataacattgggagctatggctgataagtatggaccagtcttcaccatccgaatgggttcgcgtccagtgcttgttgtgagtagttgggagacggcgaaagaatgtttcaccaccaacgacagggtcttcgcctctcgtccacgcactatagccattaaacatatgtgttatgaacatgtcatgcttgggttcgccccttacggatcatactggcgggaattgcgcaagatagtgaaccgagagcttctttcgaataatcggctagagttgttaaaacatgtatggggatctgagattaacacatccattaaagaactgtatgagttgtggttggtgaacaaaaacaacattgaagcagaaggtgaaaatgaaggtacaagtgatagggttttggtggagatggagagatggtttgcggatttgactctaaacatgtctattaagattgttgttgggaagcgatacccctccggtgttactgccggtggtagttctggttgtgatgatgatgaagctcagaggtgccggaaggccctgagagatttctttaagctggtgggtctgtttttggtgtcggatgcgatcccctttctaaggtggttggacttgggtggttatgaaagagagatgaagactactgcaagagagttggactgtttaatggaggaatggttggaagaacataaaatgaagaggagattattaatttcaccgtcggcaggtgatcatcatgaagctgcagagatcatgatcaataagcagaaggaagcagagctacaggaatatgacttcatggacgtgatgctatccatacttgatgacgatattgagggtaaaaacctttcagattacgacgtcaatgccgacactatcaacaagtctacttgcctgaatctaatcctaggtgggagcgacacaacaatggttactttaacatgggccctcgctttactactaaataatccacacgtgttacaaaaggcccaagatgagttggatatccacgtaggcagcaagagacaagtggacgattcagatatgaagaacctcatatacctccaagctatagttaaggaaacaatgcgcctatacccagcaggtccactatcagtaccacacgaatcaactgaagactgcaccgtagctggctaccacgtccctgcagggacccgtcttattgtaaatacctggaagatccaacgtgacccacgggtatggtccaacccatcagaattcaaaccagagagatttctcacagacagtcacgtggacatagatgttagaggtcggaattttgaattgatcccttttgggtcgggcaggaggtcgtgcccgggtacctcatttgcactccaagtggtgcacctggtactggcccgtttgatacatgggttcgagtttaaaacaccgtcggaagcacccattgatatgacggagagcgtaggcctaagtaattttaaagccaccccacttgatgttctgctcaccccacgtctcccttctcagctttattatgtttcttag

SEQ ID NO: 195 - DNA, 1578 bp, Sanguinaria canadensis
atggattctactttggttttcattggcctctttgctttactactagtctaccccttactactaagaagatcagtattgaagtctacttcaaatactaataagactacttataaatcgaaaaaccaagcaccggaggcggccggggcgtggccgataatcggtaatcttcatcaactcgcgggtggaggaaactgtctccataaaacgttgggagccatggctgacaagcacggaccggctttcaccatccggatgggtctacataaagcacttgtggtgagtagttgggagctagcgaaagagtgtttcactaccaacgacgtggttttcatgtcccggccgcatcaagtagccattaaacacatgggttacagcaccgccatgtttggaatcgctccttatggcccatactatcgcgaaatgagaaagatagtgactcaagagcttctctctaaccgccgcctagagttgctaaaacatgtatgggcctctgaaatcaacaactccattaaacaactctacgagaaagtcgaaggcggaccagttttgatcgaaatgaagcgatggtttgcggatttaacgctaagaacgacggttaaggtgatttgtggacagcaacaatttggaggagatgatgatgatgatgaagctggaaggtttcaaacggcgctgagagacttctttaggttgttaggtcactttcgagtggcggatgtgatacctgttctagagtggctcgattttcagggatacaagaaagagatggagaataatggaagagtgcttgataatttaatgaataaatggttggaagaacataaaaggaagaggaagaacggtggcaccgaagaggacttcatgaacgtgatgatatccaaactgcttgatgatacaaagatgctttcctattacgacgccgatactatcaacaaatctacttgcctgacactaatcctgggtgggagtgacacaaccatggttagtttaacgtgggccctttctttactagtgaatcatccacatgtgttgaaaaaggcccaagaagagttggatgtccacgtaggcaaagaaagacaggtagacgattcagatctctggagcctcacataccttcaggctattatcaaggaaacattgcgactatacccacctggtccactctcagctccacgcgaatcaacggacaactgcaccatagctggctaccacgtccctgcaggaacccgtctaatagtgaatacctggaagattcaacgtgacccacgggtatggcccgacccattagagttcaagccagagagatttctcaccacccatgtggacgtggacgttaaaggtcagaatttcgaactcctaccattcgggtcgggtagaagagcatgcccaggtgcctcattcgcgcttcgggtgctgcgcctgtcactggctcgtttgatacatgggttcgactttaaaacaccattggacgactcacccattgatatggtggagagtggaggaataactaatgttaaagacaccccacttgaagtactagtcaccccacgcctcccttctagtctttatgtttgcaaatag

SEQ ID NO: 196 - DNA, 1599 bp, Sanguinaria canadensis
atggattttgatctttaccaattctcaaaacctactatcttcattggaggcctctttgctatacttctctactttgtactcaaaaaatctagtactcccaaatccaaatcaaaattagaacaaccacccgaaccggctggcgcgtggccgatcatcggtcatcttcctctcctcggaggacccgatctccctcacataacattaggaaaattggctgataaatatggaccagccttcaccatccgaatcggtgttcataaagcggtggttattaatagttgggaggtggcgaaagagtgtttcaccaccaacgacaaggcgttttcttcccgtccgcgtcaagtagccatgaaacacatgggttacgattacgccatgtttgggttcgccccttacggaaattactggcgtgaactccgtaaaattgtgaaccgagaggttctgtctcatagtcggatcgagtctttatatcacgtatggggtactgagatcaacacgtccgttaaagaactgtacgagttgtgggggaagaaaagcaccggcagcggcggtgcaccggtcttggtggaaatgaaacgatggttctccgacatgacactcaacatgtctgttatgatggttgcaggtaagagatacaactttagtggcaacaaagctgacgatgaagctgggaggtgccaagatgggctgaggaacttctttcggttagtcggtctgttcgtgccatccgacgcgttgccgtttttggcgtggttggacattggtgggtacgagaaagaaatgaagaaagtagcgaaagagcttgatgttttagtgcaggaatggttggaagaacacaaagagaagaggttggcattgacggccgcggggaagaaaggaagcgaaaacgatttcatggacgtgatgatgaatatacttgaagatcaaaaactatcagaattcgatgcagatactatcaacaaggctacttgtctgactttaatcctcggtggaaccgatacaaatatggttaacttagtgtgggccctgactttactggttaacaatcaagatgcgttgaagaaagctcatgatgagttggacttccacgtaggcaaagatagacaagttgaagaatcagatgtaaagaacctcgtgtacatccaggctataatgaaggaaacactgcgtctatactcgggcccactgtcgggcttacgcgaatctacggaggactgcaccgtagctggttactacgtcccagcagggacccgtttgattattaatgcagcgaagattcatcgtgacccacgggtatggtctgacccaacagctttcaaaccggatagattcctcacggaacagaaagaaatggatgttagaggtcaggatttcgaaatccttccattcggggcgggtagaagaatatgcccgggtgtgtcattcgcacttcaagtattgccattggcactggctcgattaatacatgggttcgactttaaaacacccacggatgcacccattgatatgacagaaagtccaggactaactaatgctaaatccaccccactcgaagttctagtctcaccccgcctcacttctaaactttatggttgttaa

SEQ ID NO: 197 - DNA, 1668 bp, Sanguinaria canadensis
atggattctattctaaaccagttcatctcaaaacctactatggttatttgcagcctctttgctttactatccctctactttctactgatcaaaaggtctaccactaaatcaaaattacaactgccacccgagccggcgggtgcgtggcctgtcatcggtcatctccatcagttgggtggacctaacttaccccacataacattagcagccatggctgataagtatggaccaatcttcaccatgaaaattggtacgtatcgagcactcgtagtgagtagtccggaggtagcgaaagagattttcaccacccacgataggatatgggcaacccgaccaaatcaagcagccatgaaacacttgggttacgactcggccatgtttgggttcgcaccttatggaccatactggcgtgaacttcgcaagttagtgaaccgagaacttctctctaatactcggctcgatttgctacatcatgtgtgggattctgagattaacacttccattaaagaactgtacgattcgttagcgaccaaaaacaatgcaaaaggccgtggtactggcggcgccggtagtactggtcctgttttggtggaaatgaaacggtggttcgcggatttgacgctaaacataactgttaggatggttgctgggaaacgatactttggtgctaataaaacttctagtactagtactgatcaatgtgataatgaaaaaggagatagtaaagcatggaagtgccaaagggagctgagaaacttctttaggttggtaggtctgtttgtagtgtcggacgcgttaccgtttcttgggtggttggatttgggtggtcacgagagagagatgaagaatactgcaagagagttggatgttttagttcaaggatggttggatgaacataagaggaagagatcattatccgtggctgaaggcggggagaagatcaacggcgaacaggacttcatggacatgatgctgtccacaatcgacgacgctaagttatctggttatttcgacgctgatactatcaacaagtctacttgtctgaatctaatcctgggtgggagtgacacaatgatggttaatctaatttggcccctcacgttactggtgaactatccagacgagttgaagaaggtttatgatgagctggacacccacgtaggcagagatagacaagtggacgaatcagatatcaagaatctcgtgcacctcaaggctgtaatcaaggaaacaatgcgtctatacacgggtcggatcacaggcctccgccaatcatcagaggattgtaccgtggcagggtaccacgtaccagcaggtacccgcctgattgtaaacacgtggaagattagccgagacccacggtactggtccgacccgttagagttcaagccagagagatttctcacgacccatgcggatatcgagcttacaggtcagaattttgaactaatcccgtttgggtcgggcagaagatcatgcccgggtgcctcatttgcaattcaattgctgcacctggcactggctcgtctggtacatgggttctggtttgaaaggccgtcggatgcacccattgatacatcagagtgtcctggactaactaattttaaagccaccccacttgaagttctggccaccccacgcctcccttctaaactctatgttggttaa

SEQ ID NO: 198 - DNA, 1617 bp, Sanguinaria canadensis
atggattttattctgaaccagttcatctcaaaacctactatggttcttggcaccctctttgcattactatccctctactttctactgatcaaaaggtctaccactaaatcaaaattacaactaccacccgaaccggctggtgcgttgcccatcatcggtcatctccatctcctcggtggaccaaacccgccccatataacattagcaaacatggctgagaagtacggaccgatcttcagtatcaagatgggtttaaaacgagcactcatagtgagtagttcggaagtaaccaaggagtgtttcactacccatgacttgaatttcgtctctcgaccacgtcatgcggctatgaaactcatgggttataatttcgctacgtttgggttcgcgccttatggaccttattggcgcgaacttcgtatgataattaaccgagaacttctctctcaaactcggatcttgtcgttagaacatgtatggggttctgagatcaatgaatccattaaggaactgtatgatttgttgacgagaaaaggtggtggtggtggtggtccggtggtggtggaaatgaagcgatggtttgcggatttgaccttaaatatagccgttaagatggtgtgtgggaagcgatacttcggtgttaattctcctagcactagtacgactcgtgatgttcaagaagatgatgaagctcggaggtgccaaaaggggatgagaaatttctttaggttgcttggtcagtttgtggtgtccgactcgataccgtttctggggtggttggatttgggtggttaccagagggagatgaagaataccgccagagagctcgacgatttaatgcagggatggctggaagaacataagaagaagagattggaaaggaagacggccgcaggggaacaagacttcatggacgtgatgctgaacatacttgaagatggaaagctatctcaatatttcgacactgatactatcaacaagtctacttgcctgagtctaatcctgggcgggagtgacacaacgatggttaatttagtgtgggccttcagtttactggtgaaacatcaagatgcgttgaagaaaactcgtgatgagttggacatccacgtaggcagagaaagacaagtggaggaatcagatatcaagaatctggtattcctccaggctgtagtcaaggaaacatttcgtctatacgctggcccaatctcaggagtacgggaagcagcggaggactgcaccatagcaggctaccacgtcccagcagggacccgtctacttataaatagctggaagattcaccgtgacccacgggtatggtccgacccattagagttccacccagaaagatatctcgaggcgaggcatgcggacattgacgttaaaggtcagaatttcgaactcgccccattcggaatgggtcgaagagtttgcccgggttccgcatttggactgcaagtattgcacctgacactggcccgtttgatacatgggttcgagtttaaaacaccgtcagacgcacccgtggatatgacggagagtgtaggaatgagtattattaaagccaccccacttgaagttctcgtcacaccacgcctcccttctgaactatacgtctaa

SEQ ID NO: 199 - DNA, 1602 bp, Sanguinaria canadensis
atggatatttctaatctttacgagttatactatttctccacacctactctgtttgtcggaggcctctttgttttattactcatctactctctattctcatccaggcctggaattaaatcaaaattacaacagccacctgaaccggccggtgcatggcctctcatcggtcatcttcctgtcttaagtggaccggaactaccccatgtcgcattgggaaagttggctgacaagtacggaccagtcttcaccattcgtatgggtgttcataaatcacttgttgttagtgattgggaggtaattaaagagtgtttcactacccacgacaaggtcttctcgtctcgtccttgtcaagttgctatgaaactcatgggtacggccatgtttggcttctccccttacggaaattattggcgtgaacttcgcaagatcatgaacagagaggttctatctcatggtcggatcgaatctctttaccatgtatggggttctgagatcaatacgtccgttaaagaactttacgatttgtgggcgaagaaaaacaatggtggtggtccaattttggtggaaatgaagcgatggttctccgatttaacgcttaacatgtcggttatgatggccgctggaaagcgatataattttggtgatgattcttctactactaatgatgaagcggcgaggtgccaacatgcgctgagagagttttttaggttggtgggtttgtttgtgccatcggacgccttaccgtatcttgggtggttggacataggtgggtaccaaaaacaaatgaagaaagtagcaagagaattggatgatttaatgcaggtatggttggatgaacataaaaagaagaggttagcagcgaaagccgaagggaagaagggaggcgaacaagacttcatggacgtgatgatgactatacttgaggacggaaagctatctgattattacgacgctgatactatcaacaaggctacttgcttgactctaatcctgggtgggaccgacacaaacatgcttagtttagtgtggaccctggctttactgatgaataatcgacaagccttaaagaaggttcatgaagagttggatatccacgtaggcagggaaagacaagtggaagaatcagatatcaagaacctcgtatacctccaggctgtaatcaaggaagaaatgcgtctatactcgggcccactttcaggtctacgcgaaacaacggaggactgcaccatagctgggtaccacatcccagcggggacccgtttgattataaatgcatcgaagctccaccgtgatcctaaggtatggtccgacccgttagagttcaagccagagagatttcttacggaaaacgtgggcgtggatgttagaggtcagaatttggaactccaaccattcggggcgggtagaagaatctgcccgggtgtctcatttgcacttcaagttttgcccctgacgttggcccgtttgatacatgggttcgagttgaatacacctggggatgcacccattgatatgacggagtctccaggactacaaaatgctaaactcaccccacttgaagttttaatcacaccccgactcccttctaaactatatgtttaa

SEQ ID NO: 200 - DNA, 1608 bp, Sanguinaria canadensis
atgattgttattggcgccttccttgctttagtggtactagtggtctactataatctactactaagaaggccagcattattgaaatttaaaaacatgaagcagcaggcaccagaagcggccagtgcgtggccaataattggtcatctccataatctcgcgggtggcataggcggaaacggcctactccacgaaaagttgggagcaatggctgacaagcacggaccggctttcatcattcgcttggggctgcataaagcactggtggttagtagttgggaggtagtgaaagagtgtttcactacaaacgacgttgccctcatttcccgcccgcatcaagtagcttctaaacacatgggttacggcatggccatgtttgcgttcgcctcgccttatggaccatactggcgcgaattgcgtaagattgtgaagcaagaacttctctctaatagccggcttgagttgctaaaacatgtatgggcgtccgagatcaacacctctattaaacaactctacgagaaagttaaagaaggtggtggtttgccggttttggttgaaatgaagggatggttcgcggatttaaccctaaaaatgacggtaaaggtgatttgtgggaagcgacactttcgagttgcgggtaatgtaggagatcatgttgatgctgatgacgatgatgaagtaattggtgggcgatttgaaaaggcgctgagagacttttttaggttgttaggagatattcgagtggtggacgtgttaccgtttcttcggtggttggattttggcgttggttataagaaagagatggagaataatggaagagtgctggatattttaatggaggaatggttgcaagaacataaaaggaagaggatgaacggcggcaccgaagaggacttcatgaacgtgatgatatccaaattacttaatgatacaaagctgctttcctattacgatgctgatactatcaacaaatctacttgcctgactttaatcctgggtgccagcgacacaactatggttactttaacgtgggccctctctttactagtgaatcatccacaagtgctaaaaagggcccaggacgagttggatgtccacgtaggcagggaaagacaggtggaagattcagatatccagaacctcacataccttcaggctataatcaaggaaacattgcgaatatgcccaccgggtccgattcaagctccacacgaagccaaggacgactgcaccgtagctggctaccacgtccctgcagggacccgtcttatagtaaatacctggaagatccaacgtgacccacgggtatggcccaacccgtcagagttcaagccagagagatttctcacgacccatgtgggcgtggacgttagaggtcataatttcgaactcatacctttcgggtcgggtagaagatcgtgcccagggacctcgttcgcactccaagttgtgcatctgacactggctcgtttcatacatggatttgagtttaaaacaccgtcggacgcacccattgatatgacggagagtggacgaataactaatgttaaagccaccccacttgaagttctagtcaccccacgcatcccgccgtctggtctttatgtttaa

SEQ ID NO: 201 - DNA, 1719 bp, Sanguinaria canadensis
atggatttgctgatcttctccagccagttgcaaggtactgtggggttattagctttactaaccttttcctattatgtatggattttaattataaagaggatcaaaacaaccaacaccttgaaggtcatgaataaagtggcggccgcggcggcaccggaagttgccggtgcatggcccatagtgggtcatcttcctcagctagttggccctcaacagctttacaggattcttggagacatggccgacgagtatggaccgatcttcatggtccggtttgggatgtacccaactctggttgtgagcagttgggagatgataaaggagtgcttcactaccaacgacaggttcctcgctagtcgtccctctagtgctgctgggaagtacctcacttacgacttcgctatgttcggcttctccttttatggtccctattggcgtgagatccgtaagatctctactctcgaactactctcccatcgacgccttgagttgtttaagaacgtccctttcactgagatcgacacctgcatcaaaagattgtaccaactttggcgggttaaaaataatgatcatccagctgctgctccggtaattaaggtcgacatgagccaattgttgagagatctaaccttaaatacaatattgaagttggtggtaggaaagaatttattcaacgagaaggatcatggtgaacaggaagagggtcgaaagctccacctccacaagacgatagttgaattctttaaactggcaggggtttcagttgcatcggatgctcttccgttcctagggtggctggatctggatggacagaagaaaaagatgaagaggatagccaaggaaatagacttaatcgctgaaagatggcttcaagagcatcaagagaagaaatcactatcaaacaagaagctgctggctgctggcggcggcaaagtagacggtcatgacgacttcatggacgtgttgttattcattcttgacgatgattcccagttcttcaatttcagtcgcgacactgtcattaaagccacctcttgggcaatgatcctaacagccgcggacaccacatccgtgtctatgacatgggctctgacgctactactcaccaatccccgtgtcttaagaaaggcccaagatgagctggatatgaaagtcggcagagacagacacgtggaagaacgagatatcgagaacctgatctacctccaagccatcgtcaaggaaacattgcgtttgtacccggctgctccacttggagtacctcacgaggctatccaagactgcaccgtagctgggtatcaggtaagagcaggcacacgtgtgttagtgaacctatggaagctgcatcgcgacccacgtgtgtggtcgaacccatccgaattcaggccggagaggtttctaatcgacgatattgacgagcaaggtggtggtggtggtggtggtggcggtgaatcaacagctaaggatttcagaggtcaacattttgagtacataccatttgggtcaggacgaaggatgtgtcccgggatcaacttcgcccttcagatcgttcacatgacactggcacgcctacttcatgcattcgagttgaggactactacgtccgcatcactaatggacatgaccgaagaatcaggcctcaccatgcccaagaaaaccccacttgtagtcctcctccaaccacgcctccctcttccactttatgatcaccatgagtga

SEQ ID NO: 202 - DNA, 1602 bp, Stylophorum diphyllum
atggagtttctctctctacaacaccaactaatttccatttttgctcttcttcttgcttccatattcctctacaatctcttgaagaatcatggaaggaaatccaagacctcaaaaccaccagcacctgaagcatcaggtggatggccaatcatgggtcatctcaatctcttcaatggaagcgaattaactcaccaagctctaggttccatggctgacaaatacggtccagctttcaatatccgattcggttctcatcaaacactcgttgtcagtagctcggagattgttaaagaatgtttcactacaaacgatcgattcttttcaaatcggccgggatcgttagcgattaaactcatgttctacaacgctgattcagttggttacgcaccgtacggtgcttattggagagatctcagaaaaatctcaaccttaaaactcctttcgaatcatcgactggaaaccctaaaacatttgagaacttctgaagttgagtcctgttttaaacaactttataatcaatggaagaacaacaaagttggcggcgaccatgattttgctctggtgaggatggataattggtttggagacttgacatttaacgttgtggcaagaattgtcgctggaaaaaagaattttgctggaggtgcgacgaatggcgacgtcggagctcagagatataaggaagctatggatgaagcgttccggttgatgacgatttttgcgttctcagatgtggttccgtctttgggatggttggataaattgagaggtttggttggagggatgaagcgttgtggtgcggaaattgattccattgttgcgggttgggtggatgaacatagattgaagagagcttctggaaagggaggaggtcatactgatcttgaacaagattttattgatgtttgcttggagattatggaacattctactttgcctggtgatgatcctgaaattgtcatcaaatctacttgtctggacatgattttgggtgggagtgacacaacaacggtgaccctaacatgggcactctccttactattgaacaatcctcacgtgttgaaaagggctagggaggaattggatacacatgtgggaaaggacagacaagtagacgactccgatatgtctaatcttgtgtacatccaggcgatcatcaaagagacgatgagattgtacccagcaggaccactgatcgagcgaaggacatcggaggattgtgaggtaggtgggttccatgtaccggcgggcacacgcttattggtgaacttatggaagatgcaacgagatgggagtgtgtataaggaggatccattagagtttagaccagagagattcttgactagcaatgctgatgttgatctaaagggacagaattatgaactgataccatttggtgcgggtaggaggatatgtcccggtgtgtcgtttgcggtgcagttaatgcatttggtgctggctcgtctcgttcatggctttgaaatgaagacggccggagatgcgaaggttgacatgacagaaagtgcaggactaattagccacaaggttacaccgctagaagtgctgctcaaaccatgccttgcgattcaacaagctttataa

SEQ ID NO: 203 - DNA, 1602 bp, Stylophorum diphyllum
atggattcttttcttctaatccagtggtttgcagcttccatggctgctctacttgcttttgtttttctctacaatcttgtctggagttcttcaagaactacaaagggtaagaatattagaaaggcacccatggcggccggtgcatggccgattcttggtcacctacatctgtttggatccggtgagctgcctcacaaaatgctctctaccatggctgagaagtacggtcccgctttcaccatgaagtttggtaagcacacaacactagttgtgagtgacacccgtatcgtaaaagaatgttttactacccacgataccctctttgctaaccgtccttcgactactgcatttgatctcatgacttatgctaatgactcggtagccttcacaccttatggtccttattggagggaacttaggaagatatccaccctcaagcttctctctaaccaccgcctccaatctatcaaggaaattcgagtatcagaggtgaacgtatgttttagggagctatatgaatcatgcaagagtaaaactgatgcaactccggttttggtggatatgaagaaatggttcgaagaggtctcgaacaacatagtcatgagggtaatagtggggagacagaattttggttctaagattgtgcaaggcgaagacgaggccgtcaattacaagaaagtaatggatgaactcttacgtctcgctagtttgtctatgttatccgatgtggcccctgtacttggctggttggatatgttccaaggaaacaagagcgccatgaaacgaaatgccaaaaaagtagacaccatacttgagggctggttggaggagcataggatgaagaagagcgcatcaggaatctcttctgctggtgagaatgaccaggacttcatggatgttatgttgtccatcattgaggagaccaagttgtctggccgcgatgcggataccgttattaaagctacttgcttggccatgatcatgggtggtacagacaccactgccgtgagtctaacatggattgtctctttactaatgaaccatcgccatgtactgaagaaggcccgagaagaattggacgccctcgttggtaaggatagacaagttgaagattcagatttgaagaacttggtatacatgaatgccatagtcaaagaaacgatgcgaatgtacccactgggtgctatgctcgagcgagaaaccaaggaggattgtgaggttggtgggttccaagtccaaggcggcacacgattactagtgaatgtgtggaagctacaacgagacccaaacgtttggaccgatccaacagaattcaaaccagagagatttctaaacgaaaatgcggatatagacgttgggggtcaacatttcgagctactaccatttggagctggtaggagggcgtgcccgggtgtgtcgttcgcactccaattcatgcatttggtactggctcgtctcatccatggatatgaattgggaactcagaatgatgcggacgttgacttaactgagagcacagaaggacatgttaaccacaaagcttcccctctcgatctcctccttaccccacgcctcaacaaccctaatctgtatgattattag

SEQ ID NO: 204 - DNA, 1707 bp, Stylophorum diphyllum
atgactataggggctctagctttactatctttcatctattttttacgggtttcagttattaagaggaccaaatacaccaacaccgcggtcaccgccaccaacaagttggaaaatgatgaagatgaggccaatcatagtaagcgagtggttgcaccacccgaagtcgccggtgcatggccaatattgggtcatcttcctcagctagtgggactaaagcagccactgttcagggtactaggagacatggccgacaagtatggacctatcttcattgtccgatttgggatgtaccctaccctagttgtgagcagttgggagatggcaaaggagtgcttcaccaccaacgacagggtcctcgctagtcgtccagctagtgcttctggcaagtacctcacctacaattatgccatgttcggcttcactaatggcccttattggcgtgagatccgtaagatctctatgctcgaactgctatcccatcgtcgcgtagagttgctcaagcacgtaccttccactgagattgacagctctatcaaacagttgtaccatctttgggtggaaaaccaaaaccaaaataagcaaggggatcatcaggtaaaggttgacatgagccaactactcagagatctgaccttgaatatagtattgaagttggtggtaggaaagcgtcttttcaacaacaacgacatggatcatgaacaggatgaagcagctcgtaagctccagaagacaatggttgaactcattaaagtggcaggggcttcagttgcatcggatgcccttccattccttggttggttggatgtagatggactaaagagaaccatgaagaggatagccaaggaaatagatgtaatcgctgaaagatggcttcaagagcatcgacaaaaaaaactaacatcaaacgacaagggtggcagcaacaacattcaaggtggcggtggcgataacgacttcatggacgtgatgctatccatccttgacgatgattccaatttcttcatcaattacaaccgcgatactgtcattaaagccacctctctgacaatgatattagcaggttcggacaccacaactctgtccttgacatgggctctaacgctattagccaccaaccccggtgccttgagaaaggctcaagatgaacttgatactaaggtgggcagggatagacaagtagatgagcgagacatcaagaacctggtctacctccaagccattgtcaaggaaacactacggatgtacccagctgctccactagcaataccccacgaggctacccaagattgtattgttggcgggtatcacgtaacagcaggcacacgtgtgtgggtgaatctgtggaagttgcaacgggatccacacgcgtggccaaacccatcggagttcaggccagagaggtttctagccgttgagaacgattgcaagcaacagggtacttgtgatggtgaagcagcaaacatggatttcagaggtcaacactttgagtacatgccttttgggtcaggaagacggatgtgtccaggaatcaactttgcgatccagatcattcacatgacactggcacggctacttcattcattcgagttgcgggtgccagaagaagaagtaatcgacatggctgaagattcaggtctaaccatatccaaagtaacaccacttgaactcctacttaccccacgcctccctcttccactttatatatga

SEQ ID NO: 205 - DNA, 1584 bp, Stylophorum diphyllum
atggctgcccttcttcccttagctttcctctacaatatctttttggcttcatcttcgaaagctactagcaagagaacaataagtactaagaaaccgcccatggtagccggtgcatggccaattcttggtcatctccatctgtttaaagagggtgagttgcctcaccaaatgcttaaatccatggctgacaagtatggtccagccttcctcatgaagttcggtcaacaccaatccctagttgtgagtgactaccgcatcgtaaaagaatgctttactactaatgataccctcttctgcaaccgtccatccactacagctttcgatgtcatgacttacgctaatgaatcggtagctttcacagaatacagtccttactggcgcgagcttagaaagatatccactctcaagcttctctctaacaaccgtctccaggccatcaagaacctccgagaagaggaggtggatgtgagcttcaaggggttgtatgattcatggaagaataagaacaacaagagtactgctggcagtgttggtgatgaacgagctccggttttggtcgacatgaagaaatggtttgaagaagtgtcaaacaacgtggtgattagggtaatcgtgggcaaatgtaattttgggactaagatcgtgcaaggtgagaaggagggtgtggagtacaagacaatcatggatgagcttttacgacttgctagtttgtctttgttatccgatttcgcccctatacttggtttgttggatttcttccaaggccatgtccgtaccatgaaacgaaatggcaagaaactagacgtgttacttcagaggtggttggaggagcataagaggaagaagagcacaccagaggatgagcaagacttcatggatgttatgctgtcgattattgaggagagcaagctgtctggctatgacgctgataccgtcattaaagctacttgtctggccatgatcatgggtggaacagacacatccgcagtgagtctaacatggatcgtctctttactgatgaacaatcgtcaagcactaaaaaaggctcgagaagaattggacgcgcaggtggggaaggatagacaagttgaagattcagatttaaagaacttggtttacttgaatgccatcgttaaggaaacaatgcgattatacccactaggtactcttcttgaacgcgaaactaaggaggactgtgaagttggtgggtttcacctcgaaggtggtactcgtttactagtgaacgtatggatggtacagcgagacccagacgtgtggactgatccgacaaagttcataccagagaggtttcttacggagaaggcagacatagatgttgggggtgggaattttgaacttataccattcggagccggtagaagggtgtgccccggagtgtcctttgcacttcaattcctaaatttggtactagctcgtctcattcatggatatgaattgggaactccagaagatgcggatgtggatctaactgagagcccagaaggacatgtcaaccacaaagcatcccctctcgagcttctcctcaccccacgcctcagtaaccctaagctctatgattattag

SEQ ID NO: 206 - DNA, 1644 bp, Stylophorum diphyllum
atggattctgatcatcaacttctcagttaccagttctctgcaagtaatatgtttatcagcctctttgcttttgttctctactatctactagtatggaggccaacaaaatctaatcttaagatgaaaaccatatcatctgaagacaagcaagcacccgaactcgccggttcatggccagttatcggtcatcttcatctccttcatggacctaacccactccatgtagctttgggagccatggcggacaagtacggaccagctttcaccgttcgagttggtgtccatcggacacttgttgtgagtagttgggaggtagcgaaagaatgtttcactaccaatgacaaggtctttgtatctcgtccacgtcaagcagcaggaaaacacatgggttacaacaacgccatgttgcgattcgcctccgatacaccatactggacccaaatccgtaaaatgttgaaacgagacctcctctctaacaaccggattgagttgctaaaccatgcatggcattccgagattaacacatccattaaagaactgtacgagatgaattggtcatcaggcgaaggacgtcgtggcggcattagaccgccggtctcggtggacatgaagcaatggcttggtgatttaaccctaaacatgtctgttaaaatgattgctgggaagagatgttttggcagtggtgtttctgcttgtgatgaaggagaagctagaaggtgtcaaaaggggttgaaagacttcgttaggttgatgggtcagattgtggtgtcggatgcaataccatttcttggatggttggatttggatggctacgagggggaaatgaagcgagccggaaaagagctcgaccgtttactaggaggatggttggaagagcataaaatgaagagatcaccaggtgatgaagcttcagcccagaaggactggatggacttgatgctgtccgtacttggggatggaaagcttgacggctattacgacgctgatacgatcaacaaagctacttgtctggctctattgcagggtggtagcatctggacgatgcttactttattatgggcatttgccttactagtgaatcatccacatgtgatgaaaaaggcccatgatgagctggacaaccatgtaggcagagaaagacaagttgaggaatcagacatcaagaacctcacttaccttcaagccatagtcaaggaagcaatgcgtctttactcggtgtcgatgcgactactcgaatccaccgcagactgcactgtttctggctacgatgtcccagctgggactcgtctaatcgtaaatacttggaagattcagcgtgaccctcgggtatggtccgacccatctgaattccatccagagagattcctcacacaccgccatagggacatggacttgtatggtcagaattttgaaatcacaccttttgggtcgggcagaagatcatgcccaggttcctcattgggtcttcaaatggtgcaactgacaatagctcgtttgctacatgggtttgagtttaaaacaccttcggacgcccccattgatatgactgagagtgttggggtagaaaatatggttaaagcaacaccaattgaagttctgctcaccccgcgcctcctcgatgaggtttatgctttctataattag

SEQ ID NO: 207 - DNA, 1687 bp, Stylophorum diphyllum
cttttgccagttccaaggtattgtaggaatcttattagctttcctaaccttcttatattatctatggcgggcttcaattacaggattaaggactaaacccaaacacaacgactttaaagtcactaaggcagcacctgaagctgatggtgcatggcccatagttggtcattttgctcagttcataggccctcggccacttttcaggattcttggagatatggccgacaagtacggttcgatcttcatggtccgatttgggatgtacccaaccttggttgtgagcagttgggagatggcaaaggagtgcttcactaccaacgacaggttccttgctagtcgtccagctagcgctgctggcaagtaccttacctacgactttgctatgttaagtttctccttttatggcccttattggcgtgagatccgtaagatctctatgctcgaactgctatcccatcgtcgcgtagagttgctcaagcacgtaccttccactgagattgacagctctatcaaacagttgtaccatctttgggtggaaaaccaaaaccaaaataagcaaggggatcatcaggtaaaggttgacatgagccaactactcagagatctgaccttgaatatagtattgaagttggtggtaggaaagcgtcttttcaacaacaacgacatggatcatgaacaggatgaagcagctcgtaagctccagaagacaatggttgaactcattaaagtggcaggggcttcagttgcatcggatgcccttccattccttggttggttggatgtagatggactaaagagaaccatgaagaggatagccaaggaaatagatgtaatcgctgaaagatggcttcaagagcatcgacaaaaaaaactaacatcaaacgacaagggtggcagcaacaacattcaaggtggcggtggcgataacgacttcatggacgtgatgctatccatccttgacgatgattccaatttcttcatcaattacaaccgcgatactgtcattaaagccacctctctgacaatgatattagcaggttcggacaccacaactctgtccttgacatgggctctaacgctattagccacctawcccctgtgtgccttgagaaaggctcaagatgaacttgatactaaggtgggcagggatagacaagtagatgagcgagacatcaagaacctggtctacctccaagccattgtcaaggaaacactacggatgtacccagctgctccactagcaataccccacgaggctacccaagattgtattgttggcgggtatcacgtaacagcaggcacacgtgtgtgggtgaatctgtggaagttgcaacgggatccacacgcgtggccaaacccatcggagttcaggccagagaggtttctagccgttgagaacgattgcaagcaacagggtacttgtgatggtgaagcagcaaacatggatttcagaggtcaacactttgagtacatgccttttgggtcaggaagacggatgtgtccaggaatcaactttgcgatccagatcattcacatgacactggcacggctacttcattcattcgagttgcgggtgccagaagaagaagtaatcgacatggctgaagattcaggtctaaccatatccaaagtaacaccacttgaactcctacttaccccacgcctccctcttccactttatatatga

SEQ ID NO: 208 - DNA, 1569 bp, Tinospora cordifolia
atggatttaccacaaccgaccatatcaaccacacttctagcttttttcagcatcttattattcatcatatgctatcgtctcttgagcactaaatctgacaagagatcatcatcttccagaaacaaacctcttgacgctcctggagcatggcccgtcatcggtcacctacaccttctaaacggcgtcatacaacacgaaattctgggaaccatggcggacaaatacggaccggcgttcaccatctggctcggcacgcgtccggcactagtggtaagcaactgggaagtggctaaggagtgcttcaccacctgcgataaggccttagcaagccgtcccccaagcttagctttgaagatcatgggctacaacgacgcgttattcgcgttcgctccttacgggcaatactggcgtgagttgcgcaaaatagtgatgattgagcttctttctagtcggcagcttgattcgctgaagcatgtttgggattctgaaattgattcatgcatcgaagatttgtatgaaaaatgtaagggtcatcgtgaaacagtactggtgaatatgaagcagtggtttgcggatttgatgatgaacgtagtggtgagaatggtggttgggaagctgaattttgggaaaacgaaagaaggtgatgatgaggtcgcgaaggcgcaccaagggcagttgaaggcgatgagagagttcttcaagtgggtggatgtgtttatgatagaagacgcgtttccgattctgacttggttggatcctcaagggtatcaaagaaaaatgaagaatatagcgaaagatctggactcgctggttcaggggtggttagatgagcataagttgaagcaaaaaactggcgataatgggaagaaagacttcatggatatcatgctgtcggcggtcaaagatgctagtatatctgacagagacgatgagacaatctgcaaggcgacgtgcttgaatataattcttggggcgagtgataccacaacggtgaccctcacatggaccctttctttgttactaaataatcgacatgtcttgaggaaggcccaagaagaattacaagcacaagttggcaaacacagatgcgtggaagaatcagacgtcaagaaccttgtttatctacatgccatcatcaaagaagtgctaagactttacccagctgttccgcttttaggcccacgagagagtgtagccgatactgtggtggcaggctaccatatacccgcaggcacacggctaatcgtgaacctttggaagattcatcgagacccgcttaactggcctgacccgcttgagtttcgacccgagagattccttacgacccacaaagacacagatgtgtggggtcagaattttgagttgactccttttggatccggaagaaggatatgcccaggtatttcgtttgcgcttcaagtaattcctctcacactggctcgattgctccatgggtttgagctcaccacaccaggtagtgcaccggtggacatgactgaaagcactgggctcaccaacttgaaagccacacctttagatgttttcatcagtccacggcttgttctttga

SEQ ID NO: 209 - DNA, 1581 bp, Tinospora cordifolia
atggagtccattcccacagcaattaatgtgcttcttgccttcgtctccatctactatcttctgaagttccggaaaaagatcatcacaacgactagagatatcaagaagatcaaagcaccagaactaaagggtgcatggccgatcataggtcaccttcatctattcagatccgatgatcttctgcatcgaaagctcggtgccatggccgacgagttggggccagcgtttatgatccggctaggtatgcgccctgctcttgtagtgagtaactggcaaacagccaaggagtgctttactaccaaagacaggatcttcgcaacccgtcccgattcggttgctgcgaagcacatgggctacgaaaatttaatattgggcttcactcgttacggaccttactggcgtgaggttcgcaagattgtcacgctcgagcttctctccagccatcggctacacctgctcaggcatgtcaggatatcagagattgacatgtccattaagaaactccatcagctttgtaccagtaacgacaacaaatattcatcagttgtggtcgacctgaatcaatggtttaaagctttaactcttaatataatcgtgagaataatagcgggcaagcggtattacggtggagacctcgaggacgatgaggagtcgcggcggtggaagaaagctcttaacgaatttatgcatctctttggaatattttcggtgtcggatgcgattcctcagttgcagggtatggacgtgcagggacatgagcgtgtcatgaagaggactggtaaggatattgatgtgattctgagcaaatggttggaagagcacagaaggaagaagatcagggttaacagggaaggagctgagaaagatttcatagatataatgcttgacctaatcaaagaaaacgtcaatatctccggtcatgatgctgataacgtcgttaaagccacttgtttggcccttgtatcagcaggaagtgatactacaatgatcactctaacatgggctgtgtcgttacttctgaataatcatcgagtcttggagaaagctcaagccgagttggataatcaaattggaataaacagagtacatgtagaagaagaggacatcaagaatctaccataccttcaagcaattgtgaaggagactcttcgcttatatcctgctgctccattttcattgccacatgaggccatggaggaatgtactgttgcaggcttccatgttccgaaagggacacgcttaatcacaaatatctggaagctgcaacgagatccccaagtctgggaggatcctttggagttcaggccagagagattcctcacaagtgatcgtcgtcatgtggattttagagggcaacattttgaattaataccatttggatcaggaagaaggatgtgccctggcatttcatttgccattggtgtcttgcacctgacgcttgcgcgtttacttcatgaattccaccttggaactccgaccaacgcacccatagacatgaatgaaaatccaggaattaccctcgagaaagcagatcctcttcatccactcgtctctccaagacttacttccatcaactactga

SEQ ID NO: 210 - DNA, 1617 bp, Tinospora cordifolia
atggattcccagttaacttcgtttcaatccaagcccagtgcatatctaattgctgcacttcttgccttagtttctgcatactatctcatcatcaagaagaaaagcagagcaacttaccaagataactacggcaagattagggcaccggaaccaaagggtgcgtggccaatcatcggtcaccttctcctgttcaaacccaacgatgtgctgtatcaaaagcttagctcgctcgcagacgagttaggaccagcgttcatgatacggctgggcatgcgctcagctctcgtaataagtaactgggaaatagccaaagaatgcttcaccaccaacgacaggatcttcgcgacccgtccaaagttgatggcctcaaagcacatgggctacggtggcgcagaagtcggcgtcgcgccctacggtccctactggcgtgaggttcgcaaaatcatcacggtagagcttgtctccaaccaccggctcaacttgctcaaggacgtcaggatatcggagatcgatatgtccttaaaagagctctatgatctttgtatgaagaagaagaagaacggcagtggagaagaatcatcgcgggttgaattggacctgtaccaatggttcaaggacatgtcgctcaacatattggtcaagctcatcgcgggcaagcggtattacggggtggccgctgccgccaacgaagatgaggaatcgcggcggtggaagaaagcaacggaggaatcggttttcctgtttggacaatttgtggtgggggatgcgattcctttgttggagggtgtggatgtgcaagggcttgagcgtgccatgaagaagactggtaaggaaattgatgcagttttgagtaaatgggtggaagagcatagaatgaagaagcagcagcttaatggggcaagagatgagcaagatttcatagatgtgatgcttaacataataaaggatggcaagatctctgatcatgatgctgatactatcgttaaagccacttgtatgtctcttgtacaagccggaagtgacaccacaatgcttaccctgacttgggctgtgtgcttgctactaaacaattgcaatgttttagagaaagctcaagcagagttggatgatcaaattggaagaagcaaaggacgtattgtagaggaagatgacatcaagaaactgccttatctccaagcaattgtgaaggagacttggcgcttgtaccctcctgctccacttgctgtaccacgtgaagccatggaggactgtactgtagctggcttccatgttccaaagggtacacgcttaatgacaaacatatggaaactgcatcgagatcccaaagtgtgggacgattctttaaagtttaggccagaaagattcctctccagtgaacatgcacatgtggattttagagggcaacagcatgagtttatgccctttggatccgggagaaggatgtgccttggaatgccattagctattggtgtggtacaccttacacttgcccgtttacttcatgaattcgagcttgcaactccgtcaaatgcaccagtagatatgagtgaaaaagctggtcttactttggttaaagcgacgcctctaaatgttcttatcgccccacgcctttgctaa

SEQ ID NO: 211 - DNA, 1596 bp, Tinospora cordifolia
atggattcaataatactccagagtaaccttcttaccactgttataataataacatcctttggcctctttgtcctttccttttactatgttctctggaaggcaattagaactggcaacaagagaaattgcagcaaccctaaggctcctgaagctgctggaggatggcccattctcggtcatcttcatttattcagaggccaaggcctattactgcacaaaatttttggagccatggccgaaaaacacggaccagcattcaccattcggctcggaatgcgtccggcactagttgtgagcaactgggaagtggctaaggagtgtttcaccgcaaatgatcgggcccttgcgagccgccctacgagcttagccttgaagattatgggctacaacaacagcttgttcgcgttcgctccatacgggcaatattggcgtgagttgcgcaagatagtgatgcatcagcttctctctagccgtaggctcgagttactcaagaacgtttggctttctgaaattgatatatggatcaaaggcttgtacgagaattccttggttaataaagtggtggatatgaagcagtggtttggggaattgatgatgaacatagtggtgagattggtagcaggaaagcgaagttttgggaaaatcagagaaggcgatagtgaggaagcgaaggcgcatcagcggcaaattaaggcactgcgagatttcttcaggttggtggaggtttttatgatagaagatgcgtttccttttctaacttggttggatcctcgagggtatcaaaaagaaatgaagaatatagcaaaagaactggattatcttcttgaggagtggttagaagagcataaactgaagcaacaagctgcatgtgatgatcagagcaaggacttcatggatgttatgctgtcggaggtcaaggattctactatcactgaaagagatgcaaacacaatctgcaaagcgacttgcctgaatgtaattttaggtgcgagtgataccacaactctgactctcacatgggccctttccctactactgaacaacagacacgtattgaagaaggcccaggaagaattaaatgcccaagttggcaaggataaacaagtggaagaatcagacatgaagaaccttgtgtacctacatgccataatcaaagaagttctaagactctacccagctgctcctttgtcagtggcacatgagtctttagaagacaccgtggtggctggttaccatgtctccaagggcacacaggtcatattcaacctttggaaaattcaacgtgatccatctgtatggtccaacccgctagaattccaacctgagagatttctcaccacccacaaacatgtagacatttggggtcagaattttgaattgataccgttcgggtcgggaagacggatgtgcccaggcgttcctttcgctcttcaagtggtttccttaacgttggctcgattacttcatgggttcgagctcacaacaccaggtggcgcagctgttgacatgaccgagactcctgggctcactaatatgaaagcaaccccggtagaggttttccttagacctgacctccctcaccagctctatgcttga

SEQ ID NO: 212 - DNA, 1575 bp, Thalictrum flavum
atgccaagccaaaccatacaaattataatggatttctttcatcaatgtgttgcaactatattattttgtgtcttagcttcaccttttttcttttattatctactcccatggtggaaaaatgctaatgatcatgatcttgccaagagcagaggaaagcctgttcctgaagtagatggtgcatggcctattatcggtcatatgcatatgctgcaaccatcagatagcttttactcatctttggcggaaaagtatggaccaattttcacacttcgaattggtttatgcaaaacaattgtgattaatagttgggagctagctaaggaatgttgtaccactcatgatagagtgtttgcaagctcgcctgaagctacagcggcaaagatattgggatatgattatgctatgtttggacgaaacccttatgggccttactggcgtgaaatgcgcaaaataattataactgaacttgtgtcaaatcggagactggagctactaaaacatattagagtaacggagatcagtacatccatacaagaattgtaccagttgtgggaagcaaggagtagtaagaatgtaaaagaaagagttgtggtggatatgcaaaaatggtttggtgacttgatgctaaatattggtgtcgagatggttgctggaaagagatattttggtgcaagttcgaatgaagataaagaggaagcaagacagttgcataagacatttaaagatttctcgaacctatttggagtgcctgtgctatctgatgcaattccatttcttaggtggttagactataaaggacatattaaagccatgaagagatgtgcaaaacaagtagattgtatcttgcatagatggttggaggaacataaacaaaacaagacaacaattgctggggatttcatggatattttgttgtcagtacttcaggataaagagatctttggtagggatgcagacaccgtaatcaaggctacatgtctgaatatgatgctgggtgttgtagaaaccaataaggtcactgtaacaatggcactcatctcattgttgaacaatcgtcgcattttgaagaaggcacaagaagaaatagacattcatgttgggagcgataaacaagttgaagaatcagatatagagaaacttgtatatctccaagccattgtcaaggaaacgttgcgcttgtactcacctggtctaggaacacgtgagccctcagaggactgcaccatatcaggtttccatgttccaaaaggcacagaggtaatggtaaatgttcagcagattcatcgagatccaagcatttggtctaaccctcttgaatttcaaccagagagattcctcaccacacaagcaaatatagactttgggggtcaacatcatgaatacattcctttcggggcaggccgtagattatgccctgcaatctcattcgcagttctggtggtgcacttgacactagcacgtttgctgcaagggtttgattttgcaacaccaaaggatgcacctgtggaaatgaatgagagtgtggaaactctggaagttttaatcaccccacgactccctttgcatatgtattaa

SEQ ID NO: 213 - DNA, 1605 bp, Xanthoriza simplicissima
atgcacaatcccataccaaaccaatggctaccaagttcaactcttctgacgcctatcattgttagtttcctcgttatcgttctcttctatatctataagaagagaagtagtaacacgatcaggaccaagaaggcgcctgaagtagtaggagcatggcctgtaattggacatctaaatttatttagttgtcctaaaccgggtcatatagtgctgggcgaactagctgatcaatatggccccgcatttactatccattttggtatgcatccaacactggtggttagtagttcggagctggtgagggactgtttcactacgaatgacaaattattttccagccgtctagttaacaaagccatcaagtacatgttctacgatcaggacactatttcattcgcaccttatgggccttattggcgtgagcttcgtaagatgattgctcttaatcttttaaataatgaacgcatcaaaatgctccagcagcaaaggatttcagagatggatgcttgtttaaaaaagctgtacgatttatcagcaaaaagaaaagacgagaacgcaggggtattggtggatatgagtaaatggtttgccgaaatttcctttaatgtggttaccagaattgttgctggaaaacatatttttgggcctaaagttgaaagatacaagaatgtgatggaagaggcacgccgtcttatggacgtcatggttttctccgacatggtaccttatttaggatggttggatagattgcgaggagtggacagtgctataaagcggacagccaaagaattggactctgttcttgagagctgggtggaggaacatcgtcgaaagagcgtgtcaatctcagctggaacgggaggcattttcaacataaaagaagaggaggaattggattttatagacattatgttgtcgattatagccaagaacaatttaccaggtgacgatcctgatactttaatcaaggctattgtccaggaaacgtaccttgctgcgtgggacaacacaacggtaactcttacatgggtcttgtgtttgttattaaacaataagcaagttctgaaaagagctcaaaatgaattagacgctcaagttgggaaggagaggcaagtagaagattcagacattaataatcttccctatgtacaagccattgttaaagaatcattgagattatatccaccaggaccgataattgaacgggcgactactgaggattgtaacgttggtggcttccgcgtcccggcaggtacacggctttgggtaaacttatggaagttacaacgagacccaaaagtatggcctaatgatccgctagaatttcgaccagaaagatttctcaatgacaatgcagacattgatttgaggggtcagaattctgaattaataccatttggatcagggaggcgcatgtgtcccggtgtctcattttctcttcaagtcatacatctggtgattgctcgaataattcagggatttgagttaaaggccccaacagatgcagatatcgacatgtctacaacgctaggaatgataagctggaaagcaacaccacttgaagtactcatgaatccacgcttcccacccgtgttttacaagtga

SEQ ID NO: 214 - DNA, 1653 bp, Xanthoriza simplicissima
atgtctacattacaaattagcattttaacagttaaatccccgtattcacaaatgcattattatccccttcttcaccaatggctaccagcttcaatggcgctagtcagtttgctcgttatcattctcttctctatcttcaagaagagaagtagtaagatgatcaaggccaagaaggcgcctgaagtagcaggtgcatggcctctaatcggacatctcaatctatttagtggtcctaagctacttcatttagtacttggagaactcaccgatcaatatggaccggcctttatgatccatcttggtatgtatccaactttggtggtgagtaattgggagcttctaaaggactgtttcactacaaatgacatattcttctcaaatcgtccagttaacaaagcgatcaagcacatgttctacaataaagagtctattggattcacaccttatggatcctattggcgtgagcttcgtaagatgactactctcaaacttctatcaaaccaccgccttgatctgctcaagcccttgagaatttcagagatggacgcttgttttagaaacctttatgagttgtggacgaaagataaagacgggaatgcatggctgttggtggatatgagtaaatggtttggcgagatctcgtttaatgtggttgcaagaattgtagctggaaaaaagaattttgggtccaaaggtgataggtataagacagttatggaagaggtggtccgtcttatgggtctcagagctttgtcggacgcggtaccatatttaggatggttggatcagttgcgaggactggacagtgctatgaagcgggcggccaaggaattggattctgtgcttgagagctgggtggaggaacaccgcctaaagagggtgtcagtttcagctggaactggaagcactgtaaagacagcaaaagaggaggaggaggaggaggacttcatagacattacattgtcgattttggcggagaaccaattaccaggtgatgatcctgataccggcatcaagtctcttatcctggacatgatcctgggtgggagcgacacttcaacggtgacactaatatgggcaatgtgtctgctattaaacaatgtgcatgtgttgaaaagggctcaatatgaattggacgcacagattgggaaggaaagacaagtagaggattcagacataaagaatctgccctacatccaagccattattaaagaaacaatgagattatacccagcaggaccgattatcgaacgccaggctaatgaggactgcgacgtgggtggcttccatgtcccagcaggtacacggctatgggtaaacttatggaagttacaacgagacccaaatgtatggaaggacgacgcattagagtttcgacctgaaagatttctcactgatcatgcagacattgatttgaagggtcagcatctggaattaattccatttggatcaggtaggcgtatatgtcctggtatctcatttgctcttcaagtcatgcatttggcacttgctcgaattattcatggatttgagttgaagaccccaaatgattcaaatatcgacatgtctggaactcctggacttttatgctgcaaagcaacaccactccaagtactcctgactccacgttttaaccccatgttttataagtga

SEQ ID NO: 215 - DNA, 1563 bp, Xanthoriza simplicissima
atggattcacttcgacattgtttaggaggtattcttgccttactaatctttcttggttatctgcaatggaagagaggaacaagtaacaagtgcatagaagctcctcaaccggatggggcatggcctatcataggccatttgcctaggttgatgaaaccccaaataatgcatagaacgttgagcaccatggctgataaacacggcccagcgtttactctccggcttggcgtacataaaacattggtggtgagtagttgggaggtagccaaggagtgtttcactaccaacgacagagtcttcgctacccgcccaacctctatcgccgtggagatattgggctacaactacgccttatttgcctttggtccttatggctcatattggcgtgaagcccgcaagatagcaatacttgagcttctctcaaaccataggctcgagttgctgaaacatgttcggatctctgaggtgagcacatctataagagaattgtaccaagtgtggaaagaaaattgtgatatagcaaatggatctgctttggtggatatgaaaccatggtttggtgacttgacactaaacgtggttgttagaatggttgctggaaaacggtacatgggtggcagtgttaaatcggatgatgttgagggaaggcgatttcagaaggccactaaagatctctttgatttatttggactgtttatattgtcagacgcgcttccatttatgggttggttagacctccatggccataagaaagccatgaaaaaaactgccaaggagctggactccattatgcagagatggttggaagaacatcgacaaagtttattggatgatggaacaaaggaggagaagaaggacttcatgtatgtaatgttatctatccttgaggataaaaagctatttcaatatgatgccgacatcgttaacaaagctatttgcatgaatatgattatggcaggtactgatactcaaatgatcactctaacatgggtcctttctttactactcaacaatcgacacattttaaagaaggcccaagatgaaatcgactccagtgttggaaaagatagacaagtcgaggagtcagacatagtgaaactagtgtacctccaagcaattgtgaaggaagcattgcgtctctacccacccgctcctctatccgcacaacatgaggccatggaggactgcactgtggctggctactatgtcccagctggcacacgcctaataacgaacatacggaagattcaacgagatccacgcgtatggtctgacccttttgagttccatccagagagatttctcacaaaccaagcaaatgtggactttagaggtcaatcttttgagttcattccttttggatctggaagacgaatgtgcccaggcatttcatttgcgcttcaagtggtgcatttgacattagcacgtatcctacaaggttttgattttgaaacaccaatgaatgcttctgtggacatgactgaggcaccaggtctgacaaatgttaaatcaacccctcttcaagttctaatcaccccccgtctccacccaaacctatattaa

SEQ ID NO: 216 - DNA, 1572 bp, Xanthoriza simplicissima
atggatttacttaacccatattttgcaactatctttggtggtttctttgcgttactaatttttctttttatcatttcacagaagagaagtaggattcccaagatcagagcagctccagaaccagttggggcatggcctatcgtaggacacttgcctatgttacttggacccagattaccccattttgtgttgggagaccttggagagaagtacggatcagcatttactctccggcttggcatacataaaacattagtggtgagtagttgggaggttgccaaggagtgttttactacaaatgaccaagtattcgccacccgccctagcttcatggcagcgaagataatgggctataattatgctctatttggcttagcaccttacgggtcatattggcgtgaactccgtaaaatatctattattgagcttctttcaagtcataggcttgaattgctgaagcatgttcgagtctctgaggttagtacatcaatgaaagaattgtacgaggtgtgggcagaaaactgtagtaatggaaacggatctgttttggtggagatgcagcgatggtttggtgacttgacactaaatataagtgttaggatggttgctggtaagcgatactttggtactagtgctagtttggatgacgacgaggcaaggcgaatatcaaaggccacaaaagatttcttccgtttgacagggatgtttgtggtgtcggactcggttcctttcctttggtggctagattttcagggccacgagaaagccatgaagagaaccgccaaggaaatggacgatatatttgggggatggttggaggatcatcgacgaaataaacttgctggtggaacaaaggtgcagcaagacttcatggatgtgatgttgtctatccttgaggacgaaaagttctttggttataatgccgatgttgtcacaaaggctacttgcctgaatatgttgttgggtgggacggataccacaatggtcaccttgacatgggccctctcattactactgaacaaccgtcatattttgaagaaggcccaaactgaaattaacactcatgttggaaaagatacacaagttgatgaatcagatatagtgaaacttgtgtacctccaagcaattgtcaaggaaacattgcgtctctacccagctgctccactatccacaccacacgaggccactaaggactgcaccatcgctggctaccacgtcactgcagggacgcgcttgataacaaatatatggaagattcaacgagacccacgcgtatggtccaaccctagtgagtttcaaccagaaaggtttctcactgatcaagcaaatgtggacgttaggggccaacattttgaattcattccttttgggtccggtagacgatcctgcccaggaatctcgcttgggctacttgtggtgcagttggcattagcacgtttgctacaaggctttgatttcgaaacaccatcggatgcattggtggacatgactgagagcgctggattaactaatctcaaagcaacacctcttcatgtcctaattacaccgcgtctccattcaagcctgtattaa

SEQ ID NO: 217 - DNA, 1593 bp, Xanthoriza simplicissima
atggactcagttcaccaaggccaatacctaccaactccgatggtcagtgtctttgtgttttttatcagtctttactttctaattgtgtggaagacaaggtctagttccaagactaacacttgcaacgaagtacccgaagcgcctggggcgtggcctattatcgggcacctccatttgttaggtgggagtgaattaccccacaagacattaggagccatggctgataagtacggcccaatctttaagattcgtattggtgtgcatcaagcattggtggtgagtagttcggatattgtaaaggagtgtttcactactaatgataaggtttttgcttctcgtcctacctcgacagcatcaaagatcctgggctatgattatgtcatgtttggtttctctccttacggaccgtattggattgaactacgcaaaataattatgtcggaacttctctcaaaccgcaggctggaactactaaaacatgttagggactctgaaatcgatatatctatccaagaactatacaaggtgtggaagaatcatgataagtcaaaaggtccaatcttagtagacatgaagcaatggtttggagacttggcactcaatgtgattctaaggatgattgccggaaagagatactctggttcaatcttttcttctgatgagacagaagcaaggagatgtcaaaagggagcgagagatttctttaggctgttggggctattcatcattgaagatgcacttccgtatctaagttggttcgacttacaaggttacaagaaagagatgaagaacacggcaaaagaacttgattctgtttttcagagatggctggaagagcataaacgaacgagagaaaccggtgaactgaatcgggagcaggacttcatggatatcttaatgtccacactggaagagacaaagatatctgaatacgacaatgacactatcatcaagtctacttgcctgagcattgtaacaggtggaaatgacactacaatggttactctcacttggatcctatccttacttctaaacaataaacatgcactgaagaaggttcaagatgagctggacagccacgttggaaagcatagacacgtggaagagtcagatatcaagaacctcatctacctccaagctataatgaaggaagccttgcggttgtaccctgcaggtccactatcaggtcctcgggtggcagacgctgactgcaccttagcaggctaccacatcccagcaggcacccgcttacttgtgaatacctacaagattcaaagagatccattggtgtggtctgagccatctgagttccgaccagagagattcctcactagccatgtaaacatggatgttaagggtctgcaatatgaattaataccttttgggacaggtaggcgtgcgtgtccagggatgttatttgcgcttcaagtggtgccactagtcctggctcggtttctacatgagttcgagccaaagactgaaatggatatgccagtggatatgacggagactgcgggactaagtaacgccaaagcaacgccactagaagtagtaatcaccccacgccttcagcccgagctttatagtttataa

SEQ ID NO: 218 - DNA, 1587 bp, Xanthoriza simplicissima
atggacttcaccatgatcatccaatggcttctcacatcctttgctattcttgttgcatttgttctaatctggtctagtgcaacaagatctagtactaggaaaagaaacaaaacagcacctgtagctgctggtgctttgcccattgtaggacacctacatatgctaatgggacgagaactgcctcatcgattgctttcaaatatggctgacaagtatggtcctgccttcatgatgaagtatggcttacaacctgcacttgtggtgagcagtttgaagctcactaaagagtgttttgttcacaacgatagagctgtttttaaacgtccaagaagcaaagcattgaaaaacttgacctatgatcaagcttctttgggttttgcgccatatggaccactttgggtggagatgcgaaaagtatctaaaactaatctcctctctaaccaaaggcttcaaatgcaaagacatgtaagagcctcagaagtcgacgctttcatcaaagagctttacgatctatggtcttccaaatccaacaacatcaaaggcgcgccacttttggttgaaatgaataaatggtttgaagaactggcacttaacgtagtgaccaggatgctgagtggaaaaagacacattggctttaaggcaaggcgtggtgaagatagtgaatctatgcattataagaaagttgtagttgatgctactcttttaactgcaaagcttgttgtgtcagatttctttccttctcttggattggtggactacttgcaaggtgacgagagctctataaaggggacaagcaaagaactagacgcgatcctcgccacttgggtggaagagcatcgccataagaaggtttcaggctcagaggatgatgagaaagacttcattgatctcactttgtccatgatagatcaaactcagcaccaaggtgcagatgtcgacaccttcatcaagtctatgtgtgtgggcatgatctttggtgggagtgatagcacatcagtggccttagcatgggctctttccatactgatgaataatcgtcctgttttgaagaaagcccgagaagaaatcgatcgacaagtaggtagagataggaaagtgaacgatttggatgtcctcaaattggattatctcaaggcaatcgtaaaggaatcgatgcgattatgcctagtcggaccgcttcttgaacgcgtcgccgtagaagattgtgagataggcgggtatcatgttaaagcaggctcgcgcgtagtagtgaatatttggaaaatgcaacatgatccaaacttatggtctgatcctttggaattccaaccagagagatttctcactacaaacgcaaatgttgaacttagaggccagcatttcgaactccttccatttggagctggtagtcgtatttgtcctggaattacatttgccctcgaacttattcagttaacacttgctcgtctaattcatggatttgaactgggaactccgatggatgcagacgtcgacatgacagaaacatcaagtgttaccaactatagggcaacacctcttgaaatattactaacaccacgcctggatccaaagctttacaattattag

SEQ ID NO: 219 - protein, 532 aa, Argemone mexicana
MDNFLLQFQPISIAAFFVALVFLYWSYGRKSNKTLKPRAPEAAGGRPITGHLHLFYGEELTHRKLGSMADKYGPVFNIRFGSHKTLVVSNWEIVKECFTTNDRLFSNRPGTLAIKLMFYDTDSVGYAPYGNYWRELRKISTLKLLSNHRIETLKHLRTSEVESCFKQLYNQWEMKNENRVEVDKLGFASVRMDNWFGDLTFNVVARIVAGKKNFAGGAVNGDIGAQRYKVAMDESFRLMLTFAYSDVIPSLKWLDKLRGLIRDMKRCGSEIDSIVASWVEEHRLKRNSSENNNLDLEEDFIDVCLDIIESSSLPGDDPDTVIKSTCLDMILGGSDTTTVTLTWAISLILNNPHVLKRAKEELNSVVGKDRRVEDSDIPHLTYIHAIIKETMRLYPAGPLIERRTMEDCEVGGYHVPAGTRLLVNVWKMQRDGDVYKDDPLVFRPERFMTSNADVDLKGQHFELIPFGAGRRICPGVSFAVQLMHLVLARLLHEFEITTIPSEPKVDMSESGGLICHKIKPLEVLIKPRLELN

SEQ ID NO: 220 - protein, 537 aa, Argemone mexicana
MDFSSILLLLNINCFTTSLVTLLVLVMVFLYNNTRFTKPKGNKKMIKPPRLPGARPLLGHLHLFGPGELPHKVLSTMADKYGPAFTIKFGKHTTLVVSDIHTIKECLTTNDILFSNRPSSIAFDLMTYADDSVAFAHYSPYWRELRKISTLKLLSNNRLQSIKQLRLSEVNVCFKELYSLCNNNNKSGAPVLIDMKKWFKEVTTNIVIRVIVGKQNFGSKIVRGEDQEAANYKKIMDELSRLAKLSMFSDYAPLLSLFDYFRGNVSAMKRNGKELNAMLQNWLEEHKRKKNSSISNDDEQDFMDLMLSIIDETKLYGRDADTFIKAISLSMIVGGIDTVVVTLTWILALIMKNPFALKKAQEELDFFVGKERQVEDSDLKNLVYMNAIVKETLRLYPLSCILERDTKEDCEVGGYYVEGGTRLLINAWKLQRDPNVWTDPSEFKPERFLNENADIDVGGQHYELIPFGAGRRVCPGVSFALQFMDLVLARLIHGYELGTLNGEDVDLTEKTEGQINFKATPLDLIVTPRLHPNLYDY

SEQ ID NO: 221 - protein, 522 aa, Berberis thunbergii
MESIEFLVTLLLSLLALFCAYAWKRKNHTKDSKIKEPPQPAGAWPIIGHLHLISRGGLPHINMGAMADKYGPVFMIRLGVNRAVIVSNTEIVKECFTTNDKFLLNRPVGLALNLMCYNNAMFGFCRYGPYWREIHKIVMLELLSNSRLESLKHVWDSEISTSIEELYQLCQTQNKTHEGPVLVEMKDWFADMALNVSLRMIAGKRYFGASAGGNKDEARKCQKTIRDFFRLVGLFIVSDALPFLRWLDLGGHQKEMKRTFEDLDYMLQGWLDEHKLNRKSGVNGDQDFMDVMLSILDDSKFPDYDVDTVNKATCFQLIIGGTDTTTVTLTWALSLMLNHPHVLKKAQDELDIQVGKHRQVEESDIKNLKYLEAVIKETLRMRPVGPLLGPRETIEDCTIGGYRVRAGTRVMVNAWKVHRDPSVWSNPDDFKPERFLKKDIDFRDQNFEFIPFGSGRRACPGISFAVEVLPMALARLLHGFELKTQLGCKVDMTEHAGLVHAKATPLEVLVSPRLSRELYVSS

SEQ ID NO: 222 - protein, 514 aa, Berberis thunbergii
GSLALIAIIILSNIVKKSSKSLSSKGGKSAPVVHGAWPVIGHLHLLMGKELPHHALAKLADKYGPAFTLNIGAYQELVISTRDLAKECFTTKDKFFLNRPSNKAMKILTYGEASVGFAPYSPLWVEMRKVTKSNLLSHQRVLMQNRSRASEIDASFKQLYEQCNGKSGASVEMKNWFEEVMLNVVTRNVSGKRSFGTKARLGDAEAVKYKRVIDETARFMGNLVISDMVPSLWWLDNMLGAESAMKKLAIELDSLLGGWVEEHRGKKLSDDEEGDFISLTWEMIDQIQLHGLAPETFIKSMCVGVLLGGSDTTSVALTWALSLMLNNREVLKKAQEELDFHVGKDRKVDDSDLKNLVYLQAIMKETMRIYQVGPLIEREAVEDCEVGGFQIKKGNRILVNLWKLQRDPEVWSDPSEFRPERFLEDKSKVDLKGQNAELMPFGSGRRMCPGVWFGVHSTSLVLARLIQGFEIETPLDAKVDMTETSSVTNYKGSPLEVIARLPGSNLSFMICSYV

SEQ ID NO: 223 - protein, 545 aa, Corydalis chelanthofolia
MTPSISQPFELLLLLMTMESLLLQWQPTSIAVLLLAITIFLYTFTKSPPKTHKKLAPDATGGRPLMGHLHLFNSNELTHRTLGSMADKYGPAFNIRFGSHKTLVVSTWEIVKECFTTNDRSFSNRPGTLYIKLMFYNEDSVGYAPYGAYWRDLRKLSTLKLLSNHRLESLKHLRVSEMNECFKQLYEICNKGSKSVAVRMDNWFGDLTFNVVARIVAGKRNFASISNDVGAMRYKNAMDEAFRLMTVFSFSDVIPSLGWLDNLRGLVGDMKKAGKEIDSVVSGWIEEHREKRKRRSSGGNNRDGELEEEDFIDITLSILETSSLPGDDPDMTIKSTCLDMILGGSDTTTVTMTWALSLLLNNAHALKRAREELDLHVGRDRQVEDSDINNLVYIQAIIKETMRLYPAGPLIERMTKEDCEVGGFHIPAGTRLLVNLWKMQRDPNVWEDPLEFRPERFLTNNAEIDLKGQHFELIPFGTGRRICPGVSFALQLMHLALARLLHSFEVASPMDAKIDMTETAGLISHKVIPLEVLMTPRLDSKLYDY

SEQ ID NO: 224 - protein, 523 aa, Corydalis chelanthofolia
THTTEKNLPPEVPGALPVIGHLHKLGGRKGLLPYHVLGAMADKYGPAFTFQFGSNRTLVISNWEMVKECFTSTNDKLFAYRPTALFNKEVFCSDHSFGFGPYGPFWREMRKVCSLHLLSNYRLELLKHSRKSEMDECFKELYQLWSASNISKDKQPAVLVVEMKKWFEDAMFNVASRVVVGKGSLKSHEKAGGSDNEVARNKYKKGMDEARRHMGTFVISDRIPFLWWIDYLRGIHSSMKRTAKDLHAIVETWLEEHRLHCHKRRVLQLDANHEVEDMAKEEEKDFMDVLLTMADEGAIKIFDHDLDTVIKANCLDMVIAGTDTPTVMLTWTLSLLLNNPDVLKRVRDELDLHVGKERQVEESDVKNLVYLQAVFKETLRLYPAVPLNERLTMEDCNVGGYDIPAGTRLLINIWKVQRDPNVWQDPSEFRPERFLSKEKSTIDVRGLDFELIPFGTGRRMCPGISFSLQLMHLGLARLIHGFELATPMDLDVDMSANPGAFNYKSTDLQVLVSPRFHSKFYGC

SEQ ID NO: 225 - protein, 536 aa, Corydalis chelanthofolia
MDFLALQWFPASLTALLALAVLYNFWTKQRTYKNGKTSTKQAPVAAGAWPVLGHLHLFGGGELPHKMLATMADKYGPAFTMKFGTHQTLVVSNTKIVKECFTTNDTLFANRPSTTAFHLMTYDNESVAFTPYGPFWRELRKISTLKLLSNHRLQAIKDVRASEVNVCFRELYSQWRINKSEPETSDHQGPILVDMKKWFEEVSDNVVLRVIAGKQNFGSKIVHGDKEALHYKKIMDEILRLAAVSMLSDVAPLLGWLDMFQGHLSAMKRNAKEVDTMLCNWLEEHRTKRLSSDHDGVEQDFIDVMLSIVEENKFSGHDNDTVIKATVLAMIMGGTDTTAVSLTWIVSLLMNNRHVLRRAQDELDLHVGKDRQVDDSDLKNLVYLNAIVKETMRLYPLGALLERETKEDCEVGGFHVKGGTRLLVNVWKLQRDPSFWTDPTEFKPERFLADKANIDVGGQHFELLPFGAGRRVCPGVSFALQFMHLVLARLLHGFDLATPMNADVDLTESTEGHVNQKASPLNLLVTPRLHSKLYEY

SEQ ID NO: 226 - protein, 543 aa, Corydalis chelanthofolia
MEYTFSSASLFSSSSLQQWLSTLLLLISSITISLYLTRRGKSSPPMVPGAWPLIGHLHLLGGNDPLHIVLGTMADKYGHTFAMLFGKHPSLVVSSSDIVKECFTSTNDKLFSHRHVPTGVKYMFYNNDSFGFAPYGPYWREMRKMNSLSLFSHHRVEMLNRIRTSQINIWFKNLYEMCTKEKSTSTSSDGVVVEMKSWFDEMFFNVLVNMIVKPINDDEELVKKYREVATEAGRLLSSMAVSDMVPSLGWLDHLFGIVGKMKKTAKDMDAILTTWLEQHKIKSQQLRRSNGGEGAADQTEEEEKEGKGLIGDLLSMQESALFGHDRDTVIKSACQALIMAGSDSTSATLTWVLSLLLNHRDALRKAREELDQVVGKDRQVDDSDIKDLVYLQAILKETMRLYPAAPILERLAVEDCIVGGFHVQAGTTLFVNVSKLQRDPNLWTDPLEFKPERFLTGCNADVDLKGQDYELVPFGSGRRSCPAVSFAVRVMLLVLARFIHSFEVKTREEDGILDMTESSGHTNCRSSPLEVLISPRLDSKIYC

SEQ ID NO: 227 - protein, 528 aa, Corydalis chelanthofolia
MEYYSSLPFLQQWPLSSISSSPTSIATTLLIVACFTIVFLYINTSSKSNNNLKSPPKLPGAWPFMGHLHLLGGNQPAHVSLANIAEKYKSTPFMIRMGQHSTLVVSSVDLVKECFNNTNDKLFSNRSIARGIRDMFYDMESFGFAPYGYYWRELRKVSALTLFSTHRVDSVIQIKTPQIDGWFKKLYEQCTNTKGGIVEIKSWLDEMMFDVLVKMLVEPKDEGSVEKYRHVAGEALEVLGNMSIYDLVPSLGWLDHFTGLVKKYKVTGKKMDTILNSWLEDHRGEKVAEEHKGLIGKLLSMKEGSKLLGHDGDTAIKSTVQVLILGAGDSAGATLTWAISLLLNHPHIMEKLRKELDAAVGKDRQIEDSDVKKFTYLLAILKETMRLYPVTTLLQRETMEDCAIGGYHVAAGTRLMVNVWQVQRDPNAWSDPLEFKPERFLTECAHVDFSGQYSELIPFGTGRRICPALTLSVRLMLLTLARIIHSFDVKIPNGASSVDMATSVGFVNLRLTPLEVELSPRLDSKIYG

SEQ ID NO: 228 - protein, 537 aa, Corydalis chelanthofolia
MDSSLLQWYTTASMAALLALAFFYKLWSKPRTSKNGKSTLQAPVAAGAWPVLGHLHLFSGGELPHKMLAAMADKYGPAFTMKFGTHRTLVVSDTKIVKECFTTNDTLFANRPSTMAFHLMTYDNESVAFTPYGQFWRELRKISTLKLLSNHRLQAIKDVRASEVNFCFRTLYNQWRINKSETIGTGDHQGPILVDMKKWFEEVSNNVVIRVIVGKHNFGSKIARGKGEALHYKKVMDEVLRLAAVSMLSDVAPLLGWFDHLQGHVSAMKRNAKEVDTLLCSWMEEHRKKRTSNGSNGVEQDFIDVMLSIVEENKFSGHDSDTVIKATVLAMIMGGTDTSAVSLTWIVSLLMNNRHVLRRAQEELDTHVGKDRQVDDSDLKNLVYLNAIVKETMRLYPLGALLERETKEDCEVGGFHVKAGTRLLVNVWKLQRDPNFWIDPTEFKPERFLTDNANIDVGGQHFELLPFGAGRRVCPGVSFALQFMHLVLARLIHGFELDTPMNANVDMTESTEGHVNHKASALDLLITPRLRSTLYDY

SEQ ID NO: 229 - protein, 571 aa, Corydalis chelanthofolia
MFKSVPSAQAILHKLSFIHQYFLLSQTNMDSLLFQWFPASMAALVAFAFLYKLWSAPKITKNGKTSTKQAPIAAGAWPVLGHLHLFGGGELPHKMLAGMAEKYGPAFTMKFGMHRTLVVSDTKIVKECFTTHDTLFANRPSTTAFHLMTYDQESVAFTPYGPFWRELRKISTLKLLSNHRLQAIKDVRTSEVNVCFRGLYNIWQTNKNEQGGTVSDHPRPVLIDMKKWFEEVSNNVVIRVIAGKQNFGSKIVRGEEEAVKYKKIMDEVLRLAAVSMLSDVAPLLGWLDLFQGNLSAMKRNAKEVDNMLNAWVEEHRRKRLAHSAKVEATHVEQDFVDVMLSIMEENKLSSVHDDDTVIKATVLAMIMGGTDTTAVSLTWTVSLLMNHRYVLKKAQEEIDQHVGKERQVEDSDLKNLVYLNAIVKETMRMYPLGALLERETKEDCEVGGFHVKGGTRLLVNVWKLQRDPNVWIDPTEFKPERFLAENANIDVGGQHFELLPFGAGRRVCPGVSFALQFMHLVLARLIHGFELETPMNADVDLTESTEGHVNHKASPLDLLIAPRLNSKLYEL

SEQ ID NO: 230 - protein, 533 aa, Corydalis chelanthofolia
MDSLFVLLQWFSASLAAVLALAFLYNLWVKPRISDGKGNKGSTKQAPVAAGAWPVLGHLHLFGGSELPHKMLAAMADKYGPAFTMKFGTHRTLVVSNTQIVKECFTTNDTHFSNRPSTTAFHLMTYDNDSVAFTPYGPFWRELRKISTLKLLSNHRLQAIKDVRVSEVNVCFKDLYNQWKTNQNQRPVLVDMKKWFEEVSNNVVIRVIVGKQNFGSKIVRGEEEAVKYKKIMDEILRLAAVPMLSDMAPLLGWLDLFQAHKSAMKRNAKEVDNMLESWLEEHKRKRLSGVNGAEEEDFMDVMLSIMEENKFTGRDSNTVVKSTVLAMIMGGTDTTAVSLTWIFSLLMNNRHALKKAQEELDMHVGKDRQVEDSDLKNLVYLNAIVKETMRMYPLGALLERETKEDCEVGGYHVRAGTRLLVNVWKLQRDPSFWTDPTEFKPERFLTENAKTDVGGQHFELLPFGAGRRVCPGVSFALQFMHLVIARLIHGFELGTPMDADVDLTESTEGHVNHKATPLDLLIAPRLDSKVYDY

SEQ ID NO: 231 - protein, 530 aa, Chelidonium majus
MRSNYLKPTTTTIEDKSKNKISRKKPIAAKPPPEALGAWPVIGHFLLFTGKGLTHVTLGDMADKYGPAFLIRFGSHRTLVVSSWEMMKECFSAPNDKIFSNRESNLLWIKSMFYGSNSYGFSPYGPYWKELRKISTQKLLSHHRLDAMKHLQMVEVDASFKQIYNLCNKNGGSPSPSSINTTALVNMDEWLSHLMFNVIARMVSGYQSDDVGTGATSTGERFKVSMDETMRLMAIFAVSDLVPWLACVDRLRGLTRKMNRCGKDLDSIIGRLIEEHRQKRRLCRNNKGSKNEDGGHDDDQDFIDICLSIMEQSQLPGDNPEIAIKSIVLDMIFAGSHTTTLAMTWTLSLLLNHRHMLKKAKEEIDAHVGNERQVDDSDIHNLVYIQAIIKESMRLYPPSPLFERMTMEDCEVGGFHIPAGTRLFVNVWKMQRDPTVWEDPLEFRPERFLTSKREIDVKGQHYELIPFGAGRRICPGASFTLQVLHLVLARLIHGFEMTTPMDVKVDMASSAGLFSNKMTPLEVLITPRTA

SEQ ID NO: 232 - protein, 557 aa, Chelidonium majus
MKILQEFHQLTISNIVLLLLISFIFFSLSAWFIESTNYYYSSKKKKSKKTPPPEASGAWPVIGHLHQFKPDDLPHEALGDMADKYGPVFIVRFGSYRKLVVSNSEMVKECFTAANDRSFSNRPAVLGIRIMLYNTITYAFAPYGPYWRELRRISSQNLLSNHRVDMVKHLHVDEVNTLFKQLYELCNKNGGRPPTGTNTSTSAALVNMDDWLSNIMFNVIARIVNGNNKSINNERTGAINEKRYKTAMDEARRLVAIFAVSDSVPWLGWLDRVRGLIRGMNLCGKELDSIIEDIIDEHRQKRRLCTSKLGSSGDDDADNSNLEEEDNFIDACLSIEEQSQLPGENPEIVIKALILDMFAGGSDGPHFVLTWTLALLLNHPHVLKKAREEVDAHVANDRHVDVSDISNLVYIQAILKESMRLYPPNALIERMTTEDCEVGGYHIPAGTYLLVNVWKVQRDPTVWQDPSEFRPERFLLTNTKTEMEYEHIPFGAGRRRCPGMRFALQVMHLVLARLIHEFEITTPVDVIKVDMTATNGLFNHKAVPLEVLLTPRTLIRG

SEQ ID NO: 233 - protein, 541 aa, Chelidonium majus
MDYSVLLQYGWFAPSMAALLALAFLYNLFLASSPKATSKRTISTKKPPMAAGAWPILGHLHLFKEGELPHQMLKSMADKYGPAFLMKFGQHRSLVVSDYRIVKECFTTNDTHFCNRPSTTAFDVMTYANESVAFTEYSPYWRELRKISTLKLLSNNRLQAIKNLREEEVNVSFKGLYDSWKNKNNKSTGSVGDERAPVLVDMKKWFEEVSNNVVIRVIVGKCNFGTKIVQGEKEGVEYKTIMDELLRLASLSLLSDFAPILGLLDFFQGHVRTMKRNGKKLDVLLQRWLEEHKRKKSTPEDEQDFMDVMLSVIEESKLSGYDADTVIKATCLAMIMGGTDTSAVSLTWIVSLLMNNRHALKKAREELDAQVGKDRQVEDSDLKNLVYLNAIVKETMRLYPLGTLLERETKEDCEVGGFHLEGGTRLLVNVWMVQRDPSVWTDPTKFTPERFLTEKADIDVWGGNFELIPFGAGRRVCPGVSFALQFLNLVLARLIHGYELGTPDDADVDLTESPEGHLNHKASPLELLLTPRLSNPKLYDY

SEQ ID NO: 234 - protein, 537 aa, Chelidonium majus
MEFLSLEPQLISIFVLLLASSIFLYNLLKNHGRKSKTSKPPAPVASGGWPIMGHLHLFNGSELTHQTLGSMADKYGPAFNIQLGSHQTLVVSSWEIVKECFTTNDRFFSNRPGSLAIKLMFYDADSVGYAPYGAYWRDLRKISTLKLLSNHRVETLKHLRTSEAESCFKQLYNQWKNNKVGGDDDEFAIVRMDNWFGDLTFNVVARIVAGKKNFAGGATSGDVGAKRYKEAMDEAFRLMTIFAFSDVVPSLGWLDKLRGLVGGMKRCGAEIDSIVGGWVDEHRLKRASRKGGDHNDLDLEQDFIDVCLEIMEHSTLPGDDPEIVIKSTCLDMILGGSDTTTVTLTWALSLLLNNPHVLKRAREELDTHVGKDRQVDDSDMSNLVYIQAIIKETMRLYPAGPLIERRTSEDCEVSGFHVPAGTRLMVNLWKMQRDGSVYKEDPLEFRPERFLTSNADVDLKGQNYELIPFGAGRRICPGVSFAVQLMHLVLARLVHGFEMKTAGGAKVDMTESAGLISHKVTPLQVLLKPRLAIQQAL

SEQ ID NO: 235 - protein, 550 aa, Chelidonium majus
MDSMNLFQQAIAVGTLVIFLYYLWKWTSIIFTRTHQAAPPEPAGAWPIIGHLHLLAGGANQLVYHILGSMADKYGPIFTVRLGMRRALIVSNSELAKECFTTNDRIFSTRPSSVAIKLMGYDSAMFGFAPYGPYWREMRKIAVTELLSNRRLEILKNIRISEINMSIKDLYQLWVENKNSGVDGGGDGGEVVVGSPVLVEMKRWFEDVSFNVVVRMVAGKRYFGRRVESDDREEEEARRWQKAMNDFMHLVGIFVVSDAIPFLGFLDFQGYEKEMKKTAVEIDYVMGRWVEEHQRRKLERVAGGSDDQQEDFIDVMLSILKDGDQFYGYDPDTVIKSSCLSLVLGGSDTISVTLTWTVSLLLNNRNVLEKAQSELDIHVGRGRQVDESDINNLKYLQAIVKETMRLYPAGPLSAPREAMEDCTIAGFHVPKGTQLMLNLWKLHRDPRVWSDPLEFKPERFLTTGTHGDVDVKGQHFELLPFGAGRRICPGISYALQVLHLTLARLLHSFHLSTPYDIPVDMTESSGLSCPKATPLDVLLTPRLPSELYVS

SEQ ID NO: 236 - protein, 561 aa, Chelidonium majus
MDLFIFFSRFQYIVGLLAFLTFFYYLWRVSITGTRIKTNQNIMNGTNMMAPEAAGAWPIVGHLPQLVGPQPLFKILGDMADKYGSIFMVRFGMHPTLVVSSWEMAKECFTTNDKFLASRPTSAGGKYLTYDFAMFGFSFYGPYWREIRKISTLELLSHRRVELLKHVPYTEIGGSIKQLYKLWMETQNQNKQRDDHQVKVDMSQVFGYLTLNTVLKLVVGKGLFNNNDMNHEQEEGRKLHETVLEFFKLAGVSVASDALPFLGWLDVDGQKRSMKRIAKEMDLIAERWLQEHRQKRLTSNNKASSGHDDFMSVLLSILDDDSNFFNYNRDTVIKATSLNLILAASDTTSVSLTWVLSLLVTNPGALKKVQDELDTKVGRNRHVEERDIEKLVYLQATVKETLRMYPAGPLSVPHEATQDCTVGGYQVTAGTRLVVNVWKLQRDPRVWPNPSEFKPERFLPDGCEVGCGEAANMDFRGQHFEYIPFGSGRRMCPGIDFAIQIIHMTLACLLHAFEFQVPSSLDKHLVPAVIDMSEGSGLTMPKVTPLEVLLNPRLPLPLYEL

SEQ ID NO: 237 - protein, 522 aa, Cissampleos mucronata
MEAMGEYFQLISWTVFSALITIYFIFSRKTNGKKKAPEPGGAWPIIGHLHLFGAHDLLYRKLGAMADKLGPVFMIRFGMHRAVVVSNYEVAKECFTVNDKILASRPRIIASKLMGYNHAAVGLSPYGPYWREARKIATLELLSNHRLQLLKHIRISEIDMWIKELKEFCMKSSSDGPVLVQLDGWFNALTLNIMVRNIAGKRYCGGAEAFEDEESQRWKKVSRELMFLFGVFMVPDAFPVLEGIDVQGFERAMKRVGKEMDFFLSRWLEEHRRKKIELSEKGNEVNDQGAQDFIDVMLNTIKDAKIFEHDADTMIKATCMALVVAGNDTTMITLSWAVSLLLNNRGVLEKAQEELSNQIGKNRHVEEGDIESLPYLHAIVKETFRLYPAAPLSLPHEAMEDCTIAGFHVPAGTRLITNIWKLHKDPNIWPDPLEFKPERFLTTHAHVDFKGQHFEFIPFGSGRRMCPGSSLAISVLHLTLARLLHEFELKTPDDAPVDMTEGPGITLMRANPLHVLINPRHD

SEQ ID NO: 238 - protein, 534 aa, Cissampleos mucronata
MSSPIQQLLLSLTSINGGTIISAVIISLLLILTLHRLLKPINSNKTKHPPRASGAWPVMGHLHKLRGPDLPHRTLSSMADQYGPIFTINLGPTTALVISDPAVAKECFTTNDLTFSSRPTTLATTLMCYNNTMFGFAPYGPYWREVRKVVMAQLLSTRRLESLKNIWASEIDRWVKGLAQKAQSGSHGVVEVEMGDWLARLTMNIGLRLVVGKSCGEMGSEESERCLGAMREYPELLGRFALEDALPWLGRFDLQGHQREMRRAARVLDEILDGWLDEHKRNRSGLSGGDDHRDQDFMDVMLSVLEQDQDSSLSDHDADMINKSTCLNLILGMADTTMVALTWAISLLLNNKTSLKKAQEELQAQVGNERHVDESDVKNLVYLQSIIKEVLRLYPPEPLSGPREALEDCEVAGYHVPRGTRLIANLWKIHRDSSTWQDSMEFRPERFLTAHEHVDVWGQHFEFMPFGSGRRSCPGVSFEVRVLPLILARLIHAFEMTTRGDVPVDMSERPGLVISKASPLEVMISPRLPLHLFE

SEQ ID NO: 239 - protein, 536 aa, Cissampleos mucronata
MEFHLLLQAVAATLVTFFLYELWALRKKFSRLTKTPSSKALLKAKCAPEPPGAWPIIGHLPLLVSAKQPHRAFAALAEKYGPAFMLRMGMSPMLIVSTKEVAKECYTANDHVFATRPVTTAGKLMAYDHSVMGFTPFGTYWREIRKIATVELFSARRIGMLKPVRQSEVSLWMKGLHEKWVHNGNSSVSVELKSQLEELTFNLLTQMVAGKRYYGSNVAKVDEKMAGLFRHAVQQFNYHLGNSEMYDALPFMAWLDFKGDAKAMKKTQKDLDFIMQTWLDEHRLKADQMRGDAINNTRDFLDVLVMMEKTGQFSSAIKDRDTTIKALALTQLVAGVDSMANTMVWVLALLMNNPEMLAKAQDELDNNVGKDRLVEESDIPNLKYLQALLKETLRMYPVGPLLVPHEATEDCHVAGYFVPRGTGLFINAWTIQRDPNVWAEPNCFNPERFLTTHAEMDVKGQNHELLPFGSGRRSCPGVGLALQVMHLTLARILQAFELKTQSGVGIDLEECSGILLSMMHPLQVMMAPRLPSELYD

SEQ ID NO: 240 - protein, 524 aa, Eschscholzia californica
MDSLILTNWFPISIASVLTLVFLYKVLLSSRTLKDKKIKTSPMANGAWPILGHLHLFGSGELPHKMLATMADKYGSAFRMKFGKHTTLVVSDTRIVKECFTTNDTLFSNRPSTKAFQLMTYDNESVAFTPYGPYWRELRKISTLKLLSNHRLQAIKDVRASEVNVCFKSLYDQCKNPSGAPILIDMKKWFEEVSNNVVMRVIVGRQNFGSKIVQGEEEAIHYKKVMDELLRLASLSMFSDFAPLLGFLDIFQGNLSAMKQNAKKVDAILENWLEEHRKKKNSVAESEQDFMDVMLSIANESKLSGHDADTVIKATCLAMIMGGTDTTAVSLTWIISLLMNNRHALKKAREELDALVGKDRQVEDSDLKNLVYMNAIVKETMRMYPLGTLLERDTKEDCEIGGFHVKGGTRLLVNVWKLQRDPNVWVDPTEFRPERFLTENADIDVGGQHFELLPFGAGRRVCPGVSFALQFMHLVLARLIHGYDLNTLNEENVDLTESPEGHVNHKASPLDLILTPRLHYKLYE

SEQ ID NO: 241 - protein, 532 aa, Eschscholzia californica
MDTASSISLLLPWAVVVPSIATLLALLLFLFITSPKTPKRKTSSKPPPTVLPGAWPILGHLHLFKEGESPHHMLKNLADKYGPAFVMKFGQHRSLVVSNTKIVKECFTTNDTLFSNRPSTTAFDLMTYAHDSVAFTPYSPYWRELRKISTLKLLSNNRLKAIKKLRGEEVDVCFRGLYGLWKNKTKNGAPVLVDMKKWFEEVANNVVIRVIVGKLSFGTKIVDGEEEAVEYKTVMDELLRLASLSLLSDMAPILGWLDFFQGSVRKMKQTGKRLDVLLEKWLGEHREKKNLVGEDEQDFMDVMLSIVEESKLSGHEADAVIKATCLAMIMGGTDTTAVTLTWIISLLMNNRHALEKAREELETHVGKDRQVEDTDLQNLVYLSAIVKETMRLYPLGTLLERETKEDCEVGGFHIQGGTRLLVNIWMVQRDPTVWNDPSAFKPERFLTDKSEIDVGGQHFELIPFGAGRRVCPAVSFALQFLHLVLARLIHGYDLGTPSNVEVDLTESLEGHVNHKASPLELLLTPRLNPKLY

SEQ ID NO: 242 - protein, 548 aa, Eschscholzia californica
MESEIQYQTATMASILSTNLILSSIFTAFLLYFLLKMSPFRSSKNKSRKQAPKPTGSWPIIGHLLHLQGPNLPHINLAALADKYGSVFSFRIGLRPALVVSSWEIAKECLTTNDRVFVSRPPLIAMKHMGYDHALFGFSPYGPYWRELRKLVNQELLSNTRIELIKHVWDTEINTFINDLYEVWAMKSNEGGGDVVVEMKQCLYDFTLNLTLKILTGKRYFGGGGSEELREEAGRCQKAVRNFLRLVGTFTAQDVIPFLEGWLDLGGHEKEMKITGKELDSLLQKWLEEHKVKKSSAGEEGQENRGGDEEDFMGVMLTKLRDHEKLLSYYDADTINKATCLTVILGGSDTTMMTLVWALALLVNHPHVMKKLQDELDTHVSKERQVEESDIKNLAYLQSVMKETMRRYPGTPLYVRESIEDCTIAGYDVPTGTRLVVNAWKIQHDPQVWSNPFEFNPERFLTTHKDIDVRGQNFELIPFGAGRRMCPGASLGLQVVHLTLARLVHGFEFKTPDGEPMDMTESIGLTNLKATPLEIMLTPRLSSKLYVC

SEQ ID NO: 243 - protein, 554 aa, Eschscholzia californica
MGLSFDLSSHNFLQFSNPTILIGLFGLLVYLLLVNLRKRISRKNEAPEVEGGWPIIGHLHHFMGGKNKLLHVAFGAWADKYGPVYTLRMGLNKVLVVNSAEVAKECSTTNDMLFMARPYRIASEIMGYGYAMFPIAPYGPFYLKMRKMVTQELLSNSRVDSLKHVWGSEIKNAIQELHKKVLSTKGGGPISMDMKGWVSNLTFRTAMKVICGGVGVDGGGGGGGATSPATSIGEHNYDEVGSFQKALKEFFVLLGEIRISDVIPFLGWLDMRTGYVEKMKDNGKFLDNLMEEMLEEHKRKRRSLTEEEEKDGGYVEQDFMDVMISKLNDPKLLSYYDADTINKSTCLTLILSGSETTMVSIVWALALLVSHPHVLKKAQDELDTLVGRERQVDESDIKDLVYLQAVVKEALRLFPPAPLSTPRVATEDCVVSGYHVPAGTQLFVNTWKIQRNPEVWPEPSEFRPERFFTTHKDFDVRGLHYDLHPFGSGRRACPGAGFALQVVHLTLASLLHGFEIKNPSDEPIDMTESPGVTNLKATPLKVLLTPRLFSKEVY

SEQ ID NO: 244 - protein, 561 aa, Eschscholzia californica
MEKPILLQLQPGILGLLALMCFLYYVIKVSLSTRNCNQLVRHPPEAAGSWPIVGHLPQLVGSGKPLFRVLGDMADKFGPIFMVRFGVHPTLVVSSWEMAKECFTSNDKFLASRPPSAASIYMAYDHAMLGFSSYGPYWREIRKISTLHLLSHRRLELLKHVPHLEIHNFIKGLYGIWKDHQKQQQQPTARDDQDSVMLEMSQLFGYLTLNIVLSLVVGKRVCNYHADGHLDDGEEAGQGQKLHQTITDFFKLSGVSVASDALPFLGLFDLDGQKKIMKRVAKEMDFVAERWLQDKKSSLLLSSKSNNKQNEAGEGDVDDFMDVLMSTLPDDDDSFFTKYSRDTVIKANSLSMVVAGSDTTSVSLTWALSLLLNNIQVLRKAQDELDTKVGRDRHVEEKDIDNLVYLQAIVKETLRMYPAGPLSVPHEAIEDCNVGGYHIKTGTRLLVNIWKLQRDPRVWSNPSEFRPERFLDNQSNGTLLDFRGQHFEYIPFGSGRRMCPGVNLATPILHMTLARLLQSFDLTTPSSSPVDMTEGSGLTMPKVTPLKVLLTPRLPLPLYDY

SEQ ID NO: 245 - protein, 565 aa, Eschscholzia californica
MNLSSKLMGSFDLFSLNFLQFSKPASMVIIGICSFLVYFSLLNLVRRVLAPSCTMKNGKTEPPEVENGWPIIGHLHHFMGKKNKLIHEIFGDMADKYGPTFTLRMGLTKVLVVSSAEVAKECLTTNDLVFIGRPPRVANSLLGYSFAMFPFSPYGTYYSQMRKIVTHELLSTSRVESLKHVWNSEINKAIQELHHKVVSVGGGSPVLIEFKRWFSDLTLRTTVKLICGKQYFGTDGATQASMTINGGGDDDEAGKFQEALREFFCLLGKFRVSDVIPFLGWLDFGTGYKEKKNRMFIDSLMEEWLEEHKMKRRLLNEADKKESRIEQDFMDVMISKLDDPNLLSHYDADTINKATCLTLILGGSDTTMVSLVWALTLLMNHPHVLKKVQDELDFHVGRERQVEESDMKNLVYLHAVMKEAMRLNPAGTLSAPRMSTKDCTVSGYHIPAGTHLFMNTWKIQRDPNAWVEPTEFRPERFLTTHKDFDLRGQNFELLPFGSGRRSCLGANFALQVLRQTLARLLHGFDLKTPSDEPVDMTGSAGLINMKATPLEVLVTPRLFSSELYG

SEQ ID NO: 246 - protein, 550 aa, Eschscholzia californica
MNLLIFFQFLLQFQVLVGLSVLLAFSYYLWVSKNPKINKFKGKGALLAPQAAGAWPIVGHLPQLVGPKPLFRILGAMADNYGPIFMLRFGVHPTVVVSSWEMTKECFTTNDRHLASRPSNAASQYLIYEVYALFGFSLYGSSYWRDARKIATLELLSHRRLELLKHVPYTEIDTCIKQLHRLWTKNNKNQNNPELKVEMNQFFTDLTMNVILKLVVGKRFFNVDDAADHEKEEARKIQGTIFEFFKLTEGSVSAGALPLLNWLDLNGQKRAMKRTAKKMDSIAEKLLDEHRQKRLSKEGVKGTHDHNDFMDVLLSILDADQGDYSHHPFNYSRDHVIKATTLSMILSSMSISVSLSWALSLLLNNRHVLKKAQDELDMNVGKDRQVEEGDIKNLVYLQAIVKETFRMYPANPLLLPHEAIEDCKIGGFNVPAGTRVVVNAWKLQHDPRVWSNPSEFKPERFLNDQAAKVVDVRGQNFEYLPFGSGRRVCPGISFSLQTIHMSLARLVQAFELGTPSNERIDMTEGSGLTMPKTTPLHVLLNPRLPLPLYE

SEQ ID NO: 247 - protein, 532 aa, Eschscholzia californica
MEFHFPLMEQFQPFFIFALLLASFIFLYKLFNFGNRITKNGKPTAPEASGGRLIMGHLHLFNGTELTHRTLGSMADKYGPAFNIRFGSHKTLVVSSWKIIKECFTTNDRFFSNRPGSLAIKLMFYDADSVGYAPYGSYWRELRKISTLKLLSNHRLETLKHLRTSEVDSCFNQLMNSWAENKNRGDSDFAPVRMDDWFGDLTFNVVARIVAGKKNFAGGAARGDAGAQRYKSAMDEAFRLMTIFAYSDVIPSLGWLDKLRGLVGDMKRCGSEIDSVVESWVDEHRLKRRVSKKGGELDLEQDFIDVCLDIMEHSSLPGDDPEIVIKSTCLDMILGGSDTTTVTLTWALSLLLNHPQVLKRAKEELDSQVGKERQVEDSDIPNLPLIQAIIKETMRLYPAGPLIERRTMEDCEVAGFHVPAGTRLLVNLWKMQRDKEVWSEEPLEFRPERFLTSNTEVDLKGQHYELIPFGAGRRICPGVSFAVQLMHLVLARLLHGFEMTTPMGEKVDMTESAGLISHKITPLEVLIKPLRV

SEQ ID NO: 248 - protein, 510 aa, Eschscholzia californica
MDSFLLAYWVPISVASIIAFVFLYNLFSSRTLQNKKIRTAPMATGAWPILGHLHLFGSGELPHKMLAAMADKYGSAFRMKFGKHTTLVVSDTRIVKECFTTNDTLFSNRPSTKAFQLMTYDNESVAFTPYGPYWREIRKISTLKLLSNHRLQAIKDVRASEVNVCFKTLYDQCKNPSGSAPILIDMKKWFEEVSNNVVMRVIVGRQNFGSKIVQGEEEAIHYKKVMDELLRLASLSMFSDFAPLLGFVDIFQGNLSAMKRNAKKVDAILENWLEEHRKKKNSVAESQQDFMDVMLSIVEESKLSGHDADAVIKATCLAMIMGGTDTTAVSLTWIISLLMNNRHALKKAREELDALVGKDRQVEDSDLKNLVYMNAIVKETMRMYPLGTLLERETKEDCEIDGFHVKGGTRLLVNVWKLQRDPNVWVDPTEFRPERFLTENADIDVGGQHFELLPFGAGRRVCPGVSFALQLHAFSTCSPHPWIRFEYSKRRKCGSDGEPRRTCEPQSIAS

SEQ ID NO: 249 - protein, 534 aa, Glaucium flavum
MEFLSLQLQPVSIFALLVASIFLYNFLIHGKKSNNKKTTKPPAPEASGGWPIMGHLHLFNENELTHRTLGSMADKYGPAFNIRFGSHPTLVVSSWDIVKECFTTNDRFFSNRPGSLAIKLMFYDADSVGYAPYGAYWRDLRKISTLKLLSNHRLETLKHLRTSEVESCFKELYNQWRNNKTGGGGDGFAPVRMDNWFGDLTFNVVARIVAGKKNFAGGAASGDAGAQRYKEAMDEAFRLMTIFAFSDVVPALGWLDKLRGLVGGMKRCGAEIDSIVAGWVDEHRLKRSSGKGSDADLEQDFIDVCLEIMEHSTLPGDDPEVVIKSTCLDMILGGSDTTTVTLTWALSLLLNNPHVLKRAREELDTNVGKDRQVDDSDIPNLVYIQAIIKETMRLYPAGPLIERRTSEDCEVGGFHVPAGTRLLVNLWKMQRDGSVYKEDPLEFSPERFLTSNADVDLKGQNYELIPFGAGRRICPGVSFAVQLMHLVLARLIHGFEMKTPEGGKVDMTESAGLISHKVTPLEVLLKPRLAIQHS

SEQ ID NO: 250 - protein, 561 aa, Glaucium flavum
MHAKLTLIKKMEFTIINSLEIQPIISTFALLTFSILLYKILLNHGRENKNNKPKTSSSSSSIPEVAGAWPIMGHLHLFNGDELMHHKLGSMAEKYGQAFYIRFGSHKAVVVSNWEMVKTCFTTNNQIFLNRPPMLAINLLFFPTDSLSYIPYGDHWRELRKFSNQKLLSNHRIETQKNLRKLEVDYCFKQLCNQSSKYFIINNMDDQDSKFALVRMDTWFDDVTLNVLARIIAGKKKFISGGATSSGDDDNAEARRYMEALDEGLRLMTSFTFSDVLPWLGWLDNLRGLAGKMKRCGAELDSVFAGWVEEHRVKRGSRKDGDDADLEQDFIDLCWESLEQVPGNDPAKIIKLICMEMILNGSGATAVTLTWTVSLLLNNPDVLKRAREELDTHVGSHRQVDESDIPNLVYIQAIIKEGMRLYPPGPFLERSTTEDFEIDGVHVPAGTRLWVNLWKMHRDESMYQEPLEFKPERFLNSNSDVDLKGQSYQLLPFGAGRRICPGVSFALPLMHLTLARLIHGFEMKLPVGVEKVDMTENGGIINRKATHLDVLLKPRLIAQQA

SEQ ID NO: 251 - protein, 536 aa, Glaucium flavum
MDTLSIQWIVPSIATLLALVFLYNLIFTSKKTTKTNNTRKAPMASGAWPVLGHLHLFGTGELPHKMLATMAENYGTAFTMKFGNHTTLVVSDTRIVKECFTTNDTLFANRPSTKAFDLMTYANDSVAFTPYSPYWRELRKISTLKLLSNHRLQSIKDVRVAEVNVCFRGLHVLCKSKIYGAPVLVDMKKWFEEVSNNIVMRVIVGKQNFGSRIVQGQEEAVYYKSVMDELLRLASVSVLSDFAPLFGWLDFFQGNISAMKRNGKKLDVILERWMEEHRQKKISSSSSIAASGAGEDDEQDFMDVMLSIIEETKLSGRDADTVIKATCLAMIMGGTDTTAVSLTWIVSLLMNNRHVLKKAREELDSLVGKDRQVEDSDLKNFVYMNAIVKETMRLYPFGALLERDTKEDCEVGGFHVEAGTRLLVNVWKLQRDPNVWKDPLEFRPERFLVENVDIDVGGQHFELLPFGAGRRVCPGVSFALQFMHLVLARLIHGYELETLNGEDVDLTESTEGHVNHKASPLDLLITPRLDSKVYNY

SEQ ID NO: 252 - protein, 532 aa, Glaucium flavum
MDSTLVLQCFVGSMAAVSALVFLYNLIFSSSKTTKGKVLRKAPMAAGAWPILGHLHLFGSGELPHKMLSKMAEKYGPAFTLKFGKHTTLVVSDTRVVKECFTTNDTLFANRPSTTAFDLMTYANDSVAFTPYSPYWRELRKISTLKLLSNHRLQSIKEIRVSEVNVCFRELFEMSKSKTDGAAPALVDMKKWFEEVSNNIVMRVIVGRQNFGSKIVQGDAEAVNYKNVMDELLRLASLSMLSDFAPLLGWVDMFQGNKNAMKRNAKKVDTILEGWLEEHRKKNKKMSSSENDEQDFMDVMLSIIEETKLSGRDADTVIKATVLAMIMGGTDTTAVSLTWIVSLLMNNRHVLKKAREEIDAIVGKDRQVEDSDLKNFVYMNAIVKETMRLYPLGAMLERDTKEDCEVGGFQVQAGTRLLVNVWKLQRDPNVWSDPSEFRPERFLSENADIDVGGQHFELLPFGAGRRVCPRVSFALQFMHLVLARLIHGYELGTQNDELVDLTESTEGHVNHMASPLDLILTPRLSNPKLYDY

SEQ ID NO: 253 - protein, 518 aa, Glaucium flavum
MFFTSSSKTTNKNTSKKPPMAPGAWPILGHLHLFKEGELPHHMLKSMADKYGPAFLMKFGQHRSLVVSDYRIVKECFTTNDTLFSNRPSTTAFAVMTYATDSVAFTEYSPYWRELRKISTLKLLSNNRLQAIKKLRESEVNVCFRGLYDSWRKNKSEQNGAGNSIDGGNERARPVLVDMKKWFEEVSNNLVMRVIVGKRNFGTKIVEGEKEAVEYKTIMDELLRLASLSLLSDFAPILRLFDHFQGHIRTMKRNGKKLDVLLQRWLEEHRRKMSTPEEEQDFMDVMLSIVDESKLSGHDADTVIKATCLAMIMGGTDTSAVSLTWIVSLLMNNRHALAKAREELDKHVGKDRQVEESDLKNLVYLHAIVKETMRLYPLGPLLERETKQDCEVGGFDIAGGTRILVNIWMVQRDPAVWNDATEFIPERFLTEKSDVDVWGGSFELIPFGAGRRVCPGVSFALQFLHLVLARLIHGYELKTPNDMPVDLTESTEGHVNHKASPLDLLLVPRLSDLKLYDY

SEQ ID NO: 254 - protein, 537 aa, Glaucium flavum
MDSILTTVVLLSILLYFLFSWQLNKYSATKKNTKSSKQLPPEPAGSWPVIGHLHLLAKGSNLPHINLGAMADKYGPIFMIRIGLNPTLVVSSWEVAREIFTTNDQVFSSRPIQVSTKHLGFDTAMYGFAPYGPYWREISKLVKREVLSNTRLEFLKPVWGSEINTSIKELYDVCVMKNKEEGGTGPIIVEMKQWFSDLALNMSVKLVAGKRYFGASQLGNEEAARWQKALRNCFRLVGLFVVSDAIPFLRWLDVGGHEKEMKNTAKELDDLLEGWLEEHKMKKKLSLSEVEAEKKERDRVDFMDVMLSTLEHEKASDYFPADTINKATCLALILGGTDTTTVVWVWALALLVNNPNVLKKAQDELDVHVGKKRQVDESDIKNLTYLQAIIKESMRLYPAATLGIRESTEDCTVAGYHIPAGTSLIVNSWKIQHDPQVWTDPFEFQPERFLTGHMDVDIRGQSCKFLPFGSGRRSCPGTSLALQMVTLTLARLIHGFEFRTPSEAPTDMTESAGLTNVKATPLEVLVSPRLPSELYVC

SEQ ID NO: 255 - protein, 537 aa, Glaucium flavum
MELINSLEIQPITISILALLTVSILLYKIIWNHGSRKNNKSNKNNRKTSSSAGVVEIPGAWPIIGHLHLFNGSEQMFHKLGSLADQYGPAPFFIRFGSRKYVVVSNWELVKTCFTAQSQIFVSRPPMLAMNILFFPKDSLSYIQHGDHWRELRKISSTKLLSSHRVETQKHLIASEVDYCFKQLYKLSNNGEFTLVRLNTWCEDMALNVHVRMIAGMKNYVAAPGSGEYGGQARRYRKALEEALDLLNQFTITDVVPWLGWLDHFRDVVGRMKRCGAELDSIFATWVEEHRVKRASGKGGDVEPDFIDLCWESMEQLPGNDPATVIKLMCKEHIFNGSGTSSLTLAWILSLIMNNPYVIKKAREELEKHVGNHRQVEESDLPNLLYIQAIIKEGMRLYTPGPFIDRNTTEDYEINGVHIPAGTCLYVNLWKIHRDPNVYEDPLEFKPERFLKNNSDLDLKGQNYQLLPFGAGRRICPGVSLALPLMYLTVSRLIHGFDMKLPKGVEKADMTAHGGVINQRAYPLEVLLKPRLTFQQA

SEQ ID NO: 256 - protein, 571 aa, Glaucium flavum
MDLQIFFHFQGIVGSLALLSFFYYLWRLLTTTKTSICNGTTAAPPEVSGGWPILGHLLQLVGSKQPLFKVLGDMADKYGPIFVVRFGMYPTLVVSSWEMAKECFSTNDRVLATRPTSAASKYLTYNYAMFAFTFYGPYWREIRKISTIELLSHRRVEMFKHVPFMEIDTCIEQLYLLWMQNQNQNQNQPNGDPVQVNMSKVFEELTMNAVLKLVVGKRLTDDKEGEKLHKTIQEFFKLLEVSVASDVFPFLGWLDVDGQKRKMKRVAKEMDIIAEKWLEEHRQKRSSKLEEEEEEEEDDGGGKGDAAAADKDFMDVLLSLLEGDEGDSDQPFMNYSRDTVIKATSLNILVAATDTTSPTLTWAISLLLNNPHVLREAQNELDMKVGRDRQVEEQDIENLIYLQAIVKETLRLYPAGPLSIPHEAIQDCKLGGYHVRAGTRLLLNIWKLHRDPRVWSNPLEFKPERFLILSEEVCGCSRGTQNFDFKGQCFEYIPFGSGRRMCPGYNFGIQIIHMTLARLLQSFEMQPAKAKSLNDQDGPVDMREGSGLTLPKITPLKVLLTPRLYGQLYNH

SEQ ID NO: 257 - protein, 534 aa, Hydrastis canadensis
MDFSMLFQWLLVTMATLLFLNSVYNVWYKSSKNTSITTTTSKGKKAPVAAGARPFMGHLHMLVGGKQLPHQALGKLADIYGPAFIIHIGPNPELVVSSWELAKECFTTNDKYFANRPTNKAMKYLTYDEASVGFGPYGPLWVEMRKIAKSNLLSQQRLQMHKRVRVLEIDAFFKELHELWSMKKEDGPVSVDMKQWFEELTLNVITRMVSGKHKYATKARRGDSEAKQFKRVIGEAAHFTGNLLLSDIFPSLGFLDNMQGRVNSMKRTGKELDSILSSWVEEHRQKKLSGEQSEDEEKDFIDLTLSMMDEIQLHSTDSETFIKAICVGVILGGSDTTSVGITWILSLLMNHRDVLKKAQEELDQQVGMDRKVEDSDLNNLVYLRAIVKESMRLYQVGPLIERKASQDCTIGGFHVKAGTRLLVNLSKVHKDPTVWSDPLEFQPERFLTTHSNMDLKGQHFELLPFGSGRRMCPGYLFALNEMYLVLARLIQGFELGTPMDAKVDMTETSSVTNYRATPLQVLLTPRLSPKLYDY

SEQ ID NO: 258 - protein, 528 aa, Hydrastis canadensis
MAFVALIVVYNIWFKSAASRNKTSYNNKTMSKTPVVDGAKPIIGHLHLLMGGDLPHHALGRLADKYGPIFLMHIGAFPELVVSSSELAKECFTTNDKYIINRPTNKAMTYLSYEQASVGFAPYGPLWIEMRKISKSNLLSNQRIHMQKQVRVAELDAFFKELYQLCRSNDENNNNSTSHGKVLVEMNKWFEELTLNVVTRMICGKQKMGTKARLGDSDAKHYKKTIDEAAHFMGNLVISDVVPCLGMLDNLLGHVSAMKRTGKELDTIFGSWVEEHQQKIRLSGYKDDAEEEEHDFIDLTLSMMKGSTDLHGLDPATFIKSICVGMILGGTDTTSVALTWILSLLLNNRHILKKAQEELDHQVGKERKVEDSDLNNLVFIGAIVKESMRLYPVGPLIEREAIEDCQIGGVHVKAGTRLLINIWKVQQDPKIWPNPSEFRPERFLDSNMDVKGQHFELIPFGSGRRMCPGMSFAINELNLVLARLLQGFELETPMNAKVDMTETSSVTNYKGTPLQVLLTPRLSSKLYM

SEQ ID NO: 259 - protein, 531 aa, Hydrastis canadensis
MEYSHLLPWLATSIAAIFAFIFLFYVRRRKNNKAFIHNHAKKAPVVPGALPFLGHLRLFTGPILPHKALGALADKYGPAFTIYLGSHQTLVVSGRELVKECFTTNDRLFSNRPRSKAVKYLTYDEASVGFAPYGPLWVEMRKVSKLNFLSNQRIQMQKQALASELNFCFKDVYQLWLKNKELPVMVDMTKWFEEMTLNVITRLICGKQNYGSKANSGESEAKRYKQVVEKAAHLTSTVVMSDVFPFLEWFDKFQGQEKVMKKVANEFDSILGSWVDEHRRKRLLRGNNEEEEEEQDFIDLSLAMMEETQLHGVDPDTFIKSMCLGMILGGGDTTPVALTWALSLLLNNPDIMKKAQEEIDQVIGKERKLDGSDISNLVYLQAVVKESMRLYQVGPLIERETTEDCKIGDFHVEAGTRLLVNIWKVQQDPCVWSNPTEFQPERFLSSKSDMDLKGQHFELIPFGSGRRMCPAVASALQMMHLVLAKLIHGFELGTPMNAKIDMTETSSITNNMATHLQVLLNPRLNANLYDF

SEQ ID NO: 260 - protein, 543 aa, Hydrastis canadensis
MADFTMLLQWLLLTMATLLFLNAVYKSIKSSKNTINDTSFKKGKKAPVAAGARPFIGHLHMLVGGKQLPHQALGKLADKYGPAFIINIGPNPELVVSSWELAKECFTINDRCFTDRPSNKAMKYLTYDEASVGFAPYGPLWVEMRKIAKSNCAFQQRLQVQKRVRVLEIDLFFKELHELWSHAGAGATGTSVIPLSIDMKKWFEELTLNVITRMVSGKHNYATKARKGDTEAKRFKRVISEAAHFTGRLLLSDIFPSLGFLDNMQGRVNSMKRTGKELDSVLSSWVEEHRQKRVSGNKEQSPEDDDVEQDFIDLTLSMMEEIQLHWTDADTFIKAICVGVILGGSDTTSVGITWILSLLMNHPDVLKKAREELDQQVGLERKVDDSDLNNLAYLRAIVKESMRLYQVGPLIERKAKQDCNIGGFHLKAGTRLLVNLSKVHKDPTVWSDPNEFRPERFFTTHTNIDIKGQNFELIPFGSGRRMCPGYLFALSEIYLVLARLIHGFELRTPNDAKLDMTETSSVTNYRATPLQVLLTPRLSSKLY

SEQ ID NO: 261 - protein, 532 aa, Hydrastis canadensis
MDYFSMPYQWLLTSLATLIVFVFIWSITAGKTSTTSNKAKKAPPIAAGAWPIIGHLHLIMGGELPHRLLSNLADKYGPIFMLNYGSQPGLVVSSLKLAKECFVHNDRAVFKRPNSKAMKYFTYDQASFGFAPYGPLWVEMRKVSKSNLLSNQRLQLQRNQRASEVDAFIKELYQLCKKSNNGTLMVEMNKWFEELTLNVVTRMVCGKKNIGAKARHGGDNEAKYYKKVIDEATIFTAKLVASDFFPSLGWVDYLHGDESAIKQTAKELDSIIGSWVEEHRQKRLLSLNKDDYAEQDFIDITLSMIDQTQHQGIDADTFVKSMCVGMIFGGSDSTSVALNWALSILMNNRHVLKRAREEIDTLVGKDRKVNDVDVTKLVYLKAIVKESMRLCLVGPLLERVTVEDCEIGGFYVKAGSRIVVNIWKLQHDPDLWSDDVMEFRPERFLTTNSNVELRGQHFELIPFGSGSRMCPGVTFALELMHLTLARLIHGFELGTPMDAKVDMTETSSVTNYKATPLEILLTPRLHPKLYDF

SEQ ID NO: 262 - protein, 534 aa, Hydrastis canadensis
MFISITQQSMDSFHQYLATIIFGVFSFVLFLIYYLPLKRSRSDKKRAAPKPVGAWPIIGHLPMLSRHQPPHITLGNIADKYGPAFTLQLGVHRALVVSSSEVAKECFTTNDKALASRPSSVALKLMGYNNAMFGFGPYGSYWRQMRKIVVLELLSNHRLQLLKHVRISEVSTSLKELYQVWASCTNKNDKGQVLVDMQQWFGDLTLNVSVRMIAGKRYFGASAACDEDEARRFQKAIKDFLHLVGLFVVSDALPFLEWLDIQGHQKAMKRTFKELDRILGKWVEEHRRNKLDGGTNVGRDFMDVMSSILDDANISDYDADTINKATCLSLILGGTDTTMVTLTWALSLLMNNQHILKKAQDEIDIYVGKDKNVDESDIEKLVYLQAIVKETLRLYPAGPLSGPHEAIEDCTVAGYHVPRGTRLITNLWKIQRDPRIWSSPCEFQPERFLTTQANVDVRGQHFEFLPFGSGRRSCPATSFALQVVHLALARVLQGFEFETQSNAPVDMTESAGLTNVKATPLEVLITPRLPLNLY

SEQ ID NO: 263 - protein, 529 aa, Hydrastis canadensis
MESLHQYLAAVMSCIFALLLFLYYFPWKIRRSSSDNNMRSAPEAAGAWPIIGHLPMLGGHQLPHITLGNLADRYGPAFTIRLGVCRALVVSSSEVAKECFTTNDKAFATRPSSVAVKLMGYNYALFGLAPYTSYWREVRKIVILELLSNRRLELLKHVRISEVNTSIKELFQVWASSNNKNEKGQVLVEMQRWFGDLTINVAVRMVAGKRYFGASVNTCDDEEEARRFQKAIKNFFHLVGLYVLSDSLPFLEWLDFEGHQKAMKRTFKDVDCILQRWLEEHRRDKENGAMKEERDFMDVMLSILKDANLFGYEADTVNKATSLNIILGATDTTMVTLTWALSLLLNNRHILKKAEDEIDIHVGKDKAVDESDIEKLVYLQAIVKETLRLYPVAPLLAAHEAIEDCIVAGYHVPRGTRLIPNIWKIQRDPRIWSSPCDFQPERFLTTQANVDVRGQHFELFPFGSGRRMCPGISFGLQVVHLALARVLQGFEFDTPSNKAIDMTESAGLTNLKATPLQVLITPCLPLNLY

SEQ ID NO: 264 - protein, 530 aa, Hydrastis canadensis
MDSILLPTPLMVSLFALLLCLYYLIISRPRSSHNTSTKEAPEAAGALPIIGHLHLLGGRILPHITLGAMADKHGPAFMIRIGVHRALVVSSSEVAKECFTTNDKAFASRPKHTAAELMGYNYAMFGFAPYGPFWSEMRKIIMAELLSNRRLELLKYIRDFELKASIKELYMTWENHSVTNKGQVVVEMKKWFGDLTLNVILRMIAGKRYFGSNSTCDESEAKICQKGMRDFFRLLGEFLVEDAIPYLGWLDLQGFKKEMKNTAKELDILLQGWLEEHKKKREFSKDVKEEQDFMDVMMTILEDANFSDFDADTINKATCLTIISGGSDTTMLTLTWALSLLLNNQHVLKKAQDELDTHVGRDRRVDESDIKNLVYLNAIVKETLRLYPASPLLGIRVSTEDCTVAGYHVPSGTRLMVNAWKIQRDPLVWSDPFEFRPERFLTTHVNVDVKGQNFNLIPFASGRRVCPGVAFALQMLPLVLAHLLHGFKLMTQLGGPVDMTESTGLTNIKATPLEVVISPRLRPELYEMYT

SEQ ID NO: 265 - protein, 525 aa, Hydrastis canadensis
MESLHQYLATILSCIFAFLLFLYYFPWKGRRSFDNNLRTAPEAAGAWPIIGHLPMLNQRDLPHVTLGNLADRYGPAFTIRLGVRRALVVSSSEVAKECFTTNDKAFATRPSSVAVKLMAYNYAVFGFGPYGSYWREMRKIVILELLSNRRLELLKHVRISEVNTSIKELYQVWASNNKNEKGQVLVEMQRWFGDLTMNVVVRMVAGKRYFGASVTCDEEEARRFQKAIRDFSHLAGLYVLSDALPNIEWLDFEGHHKAMKKTFKDLDCILQRWLEEHRRDRENGATKGERDFMDVMLSILKDANPFDFEADTVNKATSLNMVLGGTETTTVTLTWALSLLLNNQHILKKAQDEINIRVGKDKPVDESDIEKLVYLQAIVKETLRLYPVLPLSVPHEAIEDCTIAGYHVPRGTRLITNLWKIQRDPHIWSSPCEFQPERFLTTQANVDVRGQHFELFPFGSGRRMCPGISFGLQVVHLALARVLQGFEFETPSNVPMDMTESAGLTNFKTTPLEVLITPCLPLDQY

SEQ ID NO: 266 - protein, 525 aa, Hydrastis canadensis
MDSLLQLQIIGALAALIFTYKLLKVICRSPMTDGMEAPEPPGAWPIIGHLHLLGGQDPIARTLGVMTDKYGPILKLRLGVHTGLVVSNWELAKECFTTNDRVLASRPMGAAGKYLGYNYAIFGLAPHGPYWSEVRKIVLRELLSNQSLEKLKHVRISEINTCLKNLFSLNNGNTPIKVDMKQWFERPMFNVVTMMIAGKRYFSMENDNEAMNFRKVATEFMYLTGVFVVSDALPYLEWLDLQGHVSAMKRTAKELDIHVGKWLEEHRRAKLLGETKNEDDFVDVLLTILPEDLKDNQTYIHDRDTIIKATALALFLAASDTTAITLTWALSLILNNPDVLKRAQDELDKHVGKEKLVKESDIINLVYLQAIIKETLRLYPAAPLLLPHEAMEDCTVGGYHVPKGTRIFVNIWKLQRDPRVWFDPNEFRPERFLTTHANVDFKGQHFEYIPFSSGRRVCPGITFSTQIMHLTLAHLLHEFNIVTPTKSNAGVDMTESLGITMPKATPLEVLLTPRLPSNLYNQYRD

SEQ ID NO: 267 - protein, 521 aa, Jeffersonia diphylla
MDSLQLIASVVCGLFAFLRIYYLLKKLSSNKEAPQLGGAWPIIGHLHLLGRVELPHIFFSAMADKYGPAFMIQLGMRRALVVSSAEIAKECLTTNDKALATRPSSIAAEIMGYDYAMFGLGPYGDYWREVRKIVVLEFLSNRRLELLKHVRVSEISLSLKELYQSWEKQNKADEPVLVHLDQWFGDMTLNLSVRMVAGKRYFGATAACGEDESRKVQKATREFDRLLGLFVVSDYLPFLRWLDLEGHQKLMKSIGRELDSILQGWLDEHKTRRNSGGGAKGDQDFIDVMLSVLEDGNLSNYDADKLNKATSLTMIVAGSETTMVTLTWAVCLLLNNPEVLNKAQDELDMHIGKDRQVEESDIKNLAYLQAVIKETMRLYPVAPLLIPHEAMEDCTIAGYHVRAGTRVILNGWKLQRDPFIWSDPCEFQPERFLNNDVDVRGRHFELLPFGSGRRACPGISLALNVVSLTLARLLHEFKFSNPSEGKVDMSESAGVVVAKATPLEVLIIPRLPSKFYEYYKL

SEQ ID NO: 268 - protein, 518 aa, Hydrastis canadensis
MFSLQLLSTPLFGFFTLLAIYYLLWTKSNKTKEAPQPAGAWPIIGHLHLLARSELPHITLGAMADKYGPAFMIRLGTRQAIVVSNSEIAKECLTIKDRIFATRPSLVAFKLMGYNSAMVGLSPYGPYWRELRKIIALKVLSQRRLESLKDVWDSEISSSLNHLHQIWSHQTEPNGKILVEMDQWFGDLTLNVAVKMVAGKRFFSADAACDENESRRCQKAIREFFRLLGQFVVSDSLPFLGWLDLEGYQKEMKSTAKEVDSILQKWLDEHKQKRQSAGADRDQDFMDVMLSLLEDASLSQYDTDTINKATCFSMIVGGSDTTKITLTWALTLLLNNPDVMKKSQDELDIQVGKDRHVEESDIKNLVYLEAIVKETLRLYPAAPLLAPHEATEDCIVAGYNVRAGTRLIVNAWKIQRDPLIWPNPSEFLPERYLNKDVDVKGQHFELIPFGSGRRACPGITFGLQVVSLTLARLLHEFEISIASGIKVDMTESGGLVTAKATPLKALIAPRFLYSHHHI

SEQ ID NO: 269 - protein, 525 aa, Mahonia aquifolium
MNSLQFLATPLLTLIALLCVYCIVWRKSFSRNGSKIKQAPWAGGAWPIMGHLHLLAWGDLPHITLGALADKYGPVFMMQLGMRQAIVVSSAEIARECFTTNDRILATRPSSIAVKLMAYNYAMFAFAPYGPNWREIRKTVMLELLSTPRLESLKHVWEDEISTSVKELYELCASKTKTHGHVSVDMKQRFGDLTLNVLVKLVNGKRYFGANTDYTEHESRRCQKAVRDFFSLMGLFVVSDFLPFLERLDLQGYEKEMKRVAREVDGIVQGWLDEHKRKRESSETTHDQDFMDVMLSILKDSKFSNSDYDADTINKATCFNMILGGSDTTMSTMTWALSALLNNPHMLKKAQDELEFHVGKGRQVEESDIKKLTYLQAIIKETLRLYPSAPLLAPREATEDCKIAGYHVPAGTRLIVNVWKIHRDPFVWPNPNEFQPERFLNKDVDVKGQHFELIPFGSGRRACPGVSLGLQVVSLGLARLLHGFELSIPSGSKVDMTETASLVTFKATPLEVFITPRLSPHMYVE

SEQ ID NO: 270 - protein, 502 aa, Mahonia aquifolium
YAWKRKNHTKDSKIKEPPQPAGAWPIIGHLHLISRGGLPHINMGAMADKYGPVFMIRLGVNRAVIVSNSEIVKECFTTNDKFLLNRPVGLALNLMSYNNAMFGFSRYGPYWREIHKIVMLELLSSSRLESLKHVWDSEILTSIEELYQLCQTQNKAHEGPVLVEMKDWFADMALNVSFRMVAGKRYFGASAGGNKDEARRCQKTMRDFFRLVGLFIVSDALPFLRWLDLGGHQKEMKRTFEDLDYVLQGWLDEHKLNRKSGGNGDQDFMDVMLSTLYDSKFTDYDVDTINKATCFQLILGGTDTTTVTLTWALSLMLNHPHVLKKAQDELDIQVGKHRQVEESDIKNLKYLEAVIKETLRMRPVGPLLGPREAIEDCTIGGYRVRAGTRVMVNAWKVQRDPSVWPNPDDFKPERFLKKDIDFRDQNFEFIPFGSGRRACPGISFAVELLPMALARLLHGFELKTQLGCKVDMTEHAGLVHAKATPLEVLVSPRLSRELYVSS

SEQ ID NO: 271 - protein, 529 aa, Menispermum canadense
MDSTDHHLALVIPTLLATPVLLFSFYCLLLRPRSLKKPRTNKPPEPSGSWPIIGHLHLLSQGLPHITLGAMADKLGPAFSIRLGTRRALVVSSWEVAKECYTTNDRAFASRPSSIAVKLMSYNNSILGFAPYGQYWRELRKIVVLQLLSNRRLESLKNVWESEIDLSIKELYDTWASNRGGEALMVDMKQWFGDLTMNIVVRLVVEKRCFGRSVGDDETEARRGQRALKEFLKLVGLFLVEDAFPFLSWLDVQGHQREMKRIARELDSLFQGWLEEHKRKRSIKGEAKGDQDFMDVMLSVLEDSTISTDIEDDTVIKSTCLTVVLGGSDSTVGTLTWALSLLLNNRHELKKAQDELDAYVGKERQVDESDIKNLVYLQAIVKEVLRLYPAGPLSGPRESVEDTVVAGYHVPKGTQLIVNLWKIQREPSIWADPLEFQPERFLTTHKGMDVWGQHFELIPFGSGRRSCPGTAFALQVIHLTLARLLHGFELTTPCGAPVDMSESAGLINVKTTPVEVHVAPRLPLKLYKS

SEQ ID NO: 272 - protein, 529 aa, Menispermum canadense
MILIAMGNHIELQDIILYSLGFFAATILWRIFSTYVLRRNSCSRPPEAAGKLPLIGHLHLLGANKILHHTLGDMADRHGPIFSLNLGIKRTLVITSWEVAKECFTTQDRVFATRPKSLVGKVVGYNSTVMIFQQYGPYWREIRKLAMIELLSNRRLEMLKHVRESEVNLFIKELYEQWSSNENGSKVVVEMKERFGDLTTNIVVRTVAGKKYSGTGVHGNEESRRFQKAMTDFMHLAGLFMVSDALPLLGWIDTFKGYRGKMNKTAEEIDHVLGSWLKEHQQKRKNISINHLDEDFIHVMLSAMDGNQFPDIDTETAIKGTCLSLILGGYDTTSATLTWALSLIVNNHHVLKKAQDEMDKYVGRDRQVKESDVKNLTYLQAIVKETLRLYPAAPLSVQHEAMEDCTVAGCNIPAGTRLVVNLWKMHRDPKVWSDPLEFQPDRFLQKHVNVDIWGQNFELLPFGSGRRSCPGITFAIQVLHLTLAQLLHAFQLGTVFASPIDMTESSGVTNPKATPLQVTLTPRLPPEVY

SEQ ID NO: 273 - protein, 513 aa, Menispermum canadense
MDSTYQLLSALLFILCLYYLVCKPITKTKNDEAPVPAGAWPIMGHLHMLRGPNLPHITLSSMADKHGPAFTIRLGTRRALVVSNSDLAKECFTVNDKAFSTRPSTVATKLMGYNNTMFGFAPYGPYWRELRKIVMTELLSSRRLESLASVWASEIESSVKELFAEWAENRAKGPVVVEMGEWFGNLTLNIALRMVVGKRYLREESRKCLKAMRDYPELFGRFLVEDAVPFLGWLDLIQGYQREMKKTARELDSVLEKWLVEHKDKRGSGEGKGEHQDFMDVMISVLEDSKLSYGEADTVNKSTCLNLILGATDTTMVALTWALSLLLNNKQVLKRAQQELKSQIGNNKQVSQSDIKNLLYLQATVKEALRLYPPEPLSGPREALEDCTVAGYRVRAGTRLIVNLWKIHRDPSIWQVPLEFRPERFLTAHKDVDVWGQHFELMPFGSGRRSCPGISFVLQVVPLILARLLHGFELTTPGEALVDMSESAGLVNAKVTPLEVVISPRLPLELFAG

SEQ ID NO: 274 - protein, 534 aa, Menispermum canadense
MIMMFIDYYSSWLPQTLLLQSILLAVSLVIFINLFLTRRRSYSSKSHTNIIHPPKAAGALPVIGHLYTLFRGLSAGVPLYRQLDAMADRYGPAFIIHLGVYPTLVVTCRELAKECFTTNDQTFATRPSTCAGKYIGYNYAFFGFAPYGPYWREARKIATVELLSNYRLDSLRHVREAEVGRNVDELYALHASSSTNKQNMMKIDMKQWFDQVTLNVILMMVVGKRCVTTGGNEEEVRVVKVLHEFFKHLGTLSVSDVVPYVEWMDLDGNIGRMKSTAKELDCILGRWLEEHRRERRSDFMDAMLAMVEGIKIPYYDSDTVIKAICLNLLNAGSDTLGITMTWALSLLLNNRHVLKKVKDELDVHVGKNRQVEELDVKNLVYLHAVVKETLRLFPPAPLGVPHEAMEDCVVGGFHVAKGTRLVVNVWKLHRDPSVWSDPLAFKPERFLDNNTVDVRGQHFQLLPFGSGRRGCPGITFALQVAHLTLARLLHGFEWDTPDGAPVDMSEVSVLTTAKKNPVEVLFTPRLPAEVYTQN

SEQ ID NO: 275 - protein, 523 aa, Menispermum canadense
YQLLFLQTAIAGLLFALALLVRLRFSRRNNGKKKQAPPEPAGARLIMGHIHMLNSGEQPHKTLAALADQYGPVIKLRLGLRDAIVVSNWEMAKECFTTNDKIFLSRPQTVVSKFMSYNLKMLGFAPYGPYWREIRKIVVSELLSNRRLELLKNAWTSEISSWVKELFDEWGAKEARGPVVVDMRHWFGNLAFNIGMNMVAGKRFFGPRVVSDEDGLRRVQQGLTDFFRLIGAFLLEDAVPFLSWWDSQGYQKEMKDTAREMDTLIQGLLDEHKRRRSSSSGEAKGEKDFMDVMLNILEGSKFPSGDADNINKSTCLSLMLGLTDTTTATLTWALSLLLNDPRVLKKAREELDFHVGKNRLVDTSDLMNLPYIHAIVKEVLRLHPPAPLSGHRESLEDSVVGGYHVPKGTRFMVNVWKIHHDPNKWPDPIEFRPERFLTTHKDVEVWGQNFELIPFSSGRRVCPGASLSLQVLPFTLARVLQGFEVATPGGAPVDVTESKGLSTAKETPLDVVITPRLPEKFYH

SEQ ID NO: 276 - protein, 528 aa, Nandina domestica
MDSLISFQAIVGLFILILVSYQWLGRSRSIKTNKHNEAPEPAGRWPIIGHLHLLGGSDQLLYRTLGSMADKLGPAFNIRLGSRRAFVVNSWEVAKECFTINDKALASRPITVAAKLMGYNYAVFGFAPYSPFWRAMRKIATLELLSNRRLEMLKHVRISEVDMGLKEIYGLWSKNKDSGPLMIELNRWFENLTLNMVVRMVAGKRYFGADASCDENEAQRCQKAISEFFRLIGIFVVSDAIPSLWWLDLQGHEKAMKRTAKDLDSILGGWLEQHRSRRVNGKVPTEGEQDFIDVMLSLQEGDHLSDFEYDADIAIKSTCLALILGGSDTTAGTLTWAISLLLNHPYALKKAQEELDLHVGKDRQVYDQDIKNLVYLQAIIKETLRLYPAGPLLGPREAMEDCTISGFDVRAGTRLVVNVWKIQRDPNVWSNPSEFSPERFLTSHVDVDVRGQNFELMPFGSGRRSCPGASFALQVLHLTLARFLHGFGLANPLGKPVDMNESPGLTIPKATPLNVLLTPRLDSELYGC

SEQ ID NO: 277 - protein, 520 aa, Nandina domestica
METFQFLGIPLFGFFALLCTYYLVLRKPSSTKIREPPRPAGAWPIIGHLHLLARGDLPHVTLGKMADKYGPVFKLKLGVRQAIVVSDWEVAKECYTTNDRALANRPSGLGAKIMGYNYALIGSAPYGPYWRDLRKIITLEVLSSRRLESLKHVWDSEISTSVKELYQIWADQNKAQGQVSVEMKQWFSDMTLNVAVRLAVGKKYLGATADCEKNKAVQCQKAIRNFFRLAGLFVVADYLPFLGWLDLGGHEKEMKHTAKELDYIAQEWLDDHKKKRTSNRTVDEPQDFMDVMLSILEESTFTGYDVDIINKSTCFALILGGTDTVAVTLTWALCLLLNNPHVLKKAQDELDIHVGKDRHVNESDIKNLVYLQAMIKETLRLYPAGPLLGPRQVIEDCTIAGYHVRAGTRVIVNAWKFQRDPSIWSNPCEFQPERFLDKDIDVKGQHFELIPFGAGRRACPGISFALQVLPLALARLLHGFELKNPSESQVDMTETPGMVHAKTTPLEVLITPRLSPKFYV

SEQ ID NO: 278 - protein, 495 aa, Nandina domestica
WKRPTSVKYREAPQPAGAWPIIGHLHLLARGDLHHITLGAMADKYGPAFMMRLGVHQAMVVSDSESAKECSTTNDRVLATRPSSVAVKLMGYNYAMFGFGPYGSYWREIRKIVILEVLSNHRLESLKHVWKSEISMSTKELYQLWINQNKDEGPTLVELKQWLCNMTLNIGVRTVAGKRYFGASSCDANESNRIQRAIRDFFRFVGLFVVSDFLPFLGWLDLEGYQKEMKSIARELDSILQGWLDEHTRKRQSGGTNENQDFMDIMLSVLEHSNALTHYDADTINKATCFTMILGGSDTTMVTLTWALSLLLNNPHVLKKAQDEIDIQVGKDRLVDESDIKNLVYLQAIVKETLRLYPAVPIITPHEAIEDCTIAGYHVPAGTRLIVNAWKIQRDPLIWDNPGEFQPERFLYKDVDVKGKHFELIPFGSGRRVCPGISLALQVVSLAMAHLLHEFDLAKPSEGNVDMTESVGLVNAKATPLEVLITPRLSPKFYE

SEQ ID NO: 279 - protein, 525 aa, Nigella sativa
MGSFNQINPSVVYFAAFTIFFFFFLYKILYKRRTSAKTRVAPEPAGAWPFIGHLPLLSQQNLPHVTLGVLADKYGPAFTVQLGLHKAVVVSSWEVAKECFTVNDKVLATRPSSVAVKIMCYNYAVFGFGPYGSYWREARKIVVRELLSNHRLNLLKHVLVTEISMSMNELYTVWQKNANNVSGKALVEMKQWFGDLSLNMIVKIVAGKRYFQASANSDERDQLKRGVQDLFHLVGLFLVSDALPFLSWLDIGGHEKAMRRTAKELDNILGSWLDEHKQAKLAGATKGEQDFMDVLMSILEDNNNLPEYEPDVVSKAICLGMILGGADTTTITLTWIVSLLLNNQHILKKAQDEIDSKVGKDRQVNESDIEKLVYLQAIVKETLRLYPPAPLSTQHEAMEDCTIAGYHVQAGTRLITNIWKIQRDPGVWPNPCEFQPERFLTTHANVESNGKHFEFIPFGSGRRACPGMSLGLQVVHLTLARLLQGFELETPLSVEVDMTESAGLTNLKVTPLEVLINPRLPSNLY

SEQ ID NO: 280 - protein, 517 aa, Nigella sativa
MDLTSILICIFLFIISICFLSWKRSRSLSGTRAAPEPVGAWPVIGHLRLLMGSKTPHMTLGNLADNYGPAFTIRLGTKKTLVVSSWEVAKECLTTNDKAFAGRHSTMAVEIMGYNYAFFSLGPSGQYWREIRKITVSELLSNRRLELLKHIWSSEIKTSIKELYEICAAQSQYGKKQSPMVEMQQWFSHLNLNLSARMVVGKRYFADGVEENEGDIRRFQNAIKEFFYWAGAFIIADTIPYLRWMDFLNERSMKRTAKETDHVLEGWLQEHKRNRLNGVTKEQDFMDVLLTELGDKDLCGYTADVVNKATCLNMIFGGTDTTKTGMIWTLSLILNNPQVLKKLQNEIDIQVGKDRQVDDSDIGNLVYLQATVKEAMRLYPPATIFGRESIEDCTVAGYHIQAGTRLIVNAWKIQRDPNVWPNPDEFQPERFLTNQADVDFRGQDFELIPFGAGRRACPGISLTVRVTHLTLACLLQGFNFETPLNEPVDMSEKYGLTNSKATPLNVILTPRLPSNLY

SEQ ID NO: 281 - protein, 530 aa, Nigella sativa
MDSIFHMYAPINILAATFVFIVISVWFLLWMKRSRKNSKSRRAPEPVGGWPLIGHLRLLVGPELPHVILGSLADKYGPALSIRLGMRQALVVSNCEVVKECLTTNDRCFSTRPSSVAVELMGYNYASFGLGPYGGFWREVRKIAILELLSNHRLKSLKHVWISEISGFVKELYQLCVANGNTGRQSALVEMRQWLNDLTLNVSVRMVVGKRYFGSGSEHGGEDVKRFQKAIKDFFRLAGKFTLADAIPFLRWLDFGHERAMKKTAKELDYVLARWLDQHQKNKLNCETKQVDQDFMDVMLTVLGDKDLYGFKADVVNKATCLNLILGGVDTTSVTLTWALSLLLNNPNILNKAQEEIDVQIGKDRQVDDNDLGKLVYLEAIVKETMRLYPAGPLSGARAAIEDCMVAGYHVPKGTRLIVNTWKIQRDPEKWDNPSEFRPERFLITTTNGHVEVWGQHFEYIPFGSGRRICPAISFSLQLVHLTLARLLQAFSFQTPSNAAVDMTETPGLVNFKATPLQILLTPRLPSSLY

SEQ ID NO: 282 - protein, 527 aa, Nigella sativa
MLSIHDSTMVFLQLQAICGIFGFIFIITWWTRWKSSNKMKAPEVAGAWPVIGHLHLLGGGRPLYQLLGDMSDKYGPAFTLRMGIQKALVVSSWEVAKECLTTNDRALATRPSSAGGKYMGYNNALIPFSPYGPYWRDMRKIATLELLSNHRLEELKHVREMEINTCISDMYKLCQVEDGVEIKPISVDLSQWFADLTFNVVVMMITGKRYIGSTDAGDMNEIRHFQAALVKFMRLLRISLLVDVFPVLQWINYGGFKGVMKSTARDIDSVLENWLQEHQRKRLSPDFNGNHDFIDVMISTLEGTEFSDYDHNTIIKAISMAMVVGGTDTTTTTLIWAISLLLNNPNAMKKVQEELEIHVGKERNVDGSDIQHLVYLQAVVKETLRLYPPVPLSVMHQAMEDCVIGSYNIQAGTRVLFNLWKLHRDSSVWSDPLEFRPERFLTSHVDVDVRGQHFELIPFGSGRRSCPGISFALQVIHLTIARLFHGFNLTTPGNSSVDMSEISGATLSKVTPLEVLVTPRLSSKLYN

SEQ ID NO: 283 - protein, 520 aa, Nigella sativa
MDFLIYVAAFAAAFFFLLFYNILSKRITGTKRRIAPEPAGAWPFIGHLPMLFGPNLPHVTLGALADKYGPAFTIQLGLHKALVVSSWEVAKDCFTVNDKALATRPTSAAVKIMAYNCAVFSFSPYGSYWREARKIAILELLSHHRLDLLKHVRKSEVSTSIRELYQFWQKNATEVTKFAQLEMKQWFGDLTMNLIVRMVAGKRYASVQSDDDGEGKRLQKAVNDFFHLVGLFVVSDALPFLGWLDIGGNLKTMKKTARELDSIMECWLKHQARRSNGEQDFLDVMLSILREDNKLQEYDGDVVVKAMCLNMILGGADSTTITLTWTISLLLNNRHILQKAQDEIDSKVGKDRQVNESDIEKLVYLQAIVKETLRLYPPAPLSSQHEAIEDCTIAGYHIPAGTRLITNLWKIQHDPSVWHNPSEFQPERFLTTQANVDFRGQNFEFIPFGFGRRSCPGTSLGLQMVHLPLARLLQGFTFETPSNAAVDMTESAGLTNHKVTPLEVLISPRLRFDLYQESPP

SEQ ID NO: 284 - protein, 525 aa, Nigella sativa
SFNQTYTGFICLSVFASFFFFFLYSVQQKRRTGRKARYAPEPTGAWPLIGHLPILFEPNLPHIQLGALADKYGPVFSIKLGLRKALVVSSWEVVKECFTVKDKVLASRPSSVAVKIMGYDYAVYAFGPYGSYWREARKLTILELLSDHRLDLLKHVRVSEVSMSMKELLKFCQKNANNVSGKALLVDMKQWFGDLTLNVIVRMVAGKSYLGASAKLEDGEQKRLQNAIHEFFRLAGLFVVSDALPILSWLDIGGHEKAMRRNAREIDKIMSSWLDEHRRNKLAGVTNGEQDFMDVLLSKFENSNLPGYEPDVAIKAICLNMILGAADTTIVTLTWVVSLILNNRQILKKAREEIENKVGKDRQVNESDIEKLVYLQAIVKETLRLYPAAPLSAHHESMEDCTIAGYHVPAGTQLITNLWKIQRDPRVWPNPCEFLPERFLTTHANVNYKGQNFEFIPFGYGRRSCPGMSFGLQMVHLVLASLLQGFELETPLNEAVDMTESAGLTNLKATPLEVLITPRMPLNLY

SEQ ID NO: 285 - protein, 509 aa, Nigella sativa
VTVIYLFTFAIFFYLYSILWKNPRKSAKTRVAPEPAGAWPFMGHLPMLLEPNLPHIKLGALADKYGPAFTVQLGLHKALVVSSWEVAKECFTVNDKVLADRPSSVAVKIMGYDNAVFAFGPYGSYWREARKISTVELLSNHRLSLLQHFRISEASMSMKELYQLCANNGKALVEMKKWFGDLSLNVIVRMVAGKRYAKASEDDERRQLQKGLKDFFYLVGLFVVSDALPILSWLDIGGHEKAMRRTAKELDTIMERWLDEHRRAKLAGVTKGEQDFMDVLLSILEDGKLPHYESNTVNKAICLTMILGAAHTTTVTLIWTLSLLLNNRHILNKAQDEIDSEVGKDRAVTESDIKNLVYLQAIVKETLRLYPAAPLPAHREVMEDCIIAGYHVPVGTRIITNLWKIQRDPRVWSNPCAFQPERFLTTHSNVDFRGQNFEFIPFGSGRRSCPGISLGLQMVHLALARLLQGFELETPLNLGIDMTESSGLTNLKVTPLEVVITPRLPSNLY

SEQ ID NO: 286 - protein, 562 aa, Papaver bracteatum
MAYLMIKKSFHLFSDQPTSVSTLIVLAFLLTLSPVIIYYEQKKRGLRRNRTSSSCTAITTTPLPEASGAWPVIGHLLLFMNENDLNHATLGNMADKYGPIFSLRFGSHRTLVVSSWEMVKECFTGANDKFFSNRPSSLAVKLMFYDTESYGFAPYGKYWRELRKISTHKLLSNQQLDKFKHLRISEVDNSFKKLHDLCSNNKLGGETTSVANLVRMDDWFAYLTFNVIGRIVSGFQSNAVSGATSSQEKYKLAIDEVSNLMATFAVSDVVPCLGWIDRLTGLTGKMKKCGKKLDAVVGDAVEVHRQKKLKISRNTAGELTEHEEEDFIDVCLSIMEQSQIPGNNPEISVKSIALDMLSGGSDTTKLIMTWTLSLLLNHPDILDKAKEEVDTYFRKKKISDNTPVVDAADVPNLVYIQAIIKESMRLYPASTLMERMTSDDCEVGGFHVPAGTRLWVNVWKMQRDPRVWNDPLVFRPERFLSNDKGMVDVKGQNYELIPFGTGRRICPGASFALEVLHLVLTRLILEFEMKAPEGEIDMRARPGFFNNKVVPLDVLLTPRTLD

SEQ ID NO: 287 - protein, 519 aa, Papaver bracteatum
MNNYSSSPASSTETAVLCHQRQQSCALPISGLLHIFMNKNGLIHVTLGNMADKYGPIFSFPTGSHRILVVSSWEMVKECFTGNNDTFFSNRPIPLAFKIIFYAGGVDSYGLALVPYGKYWRELRKICVHNLLSNQQLLKFRHLIISQVDTSFNKLYELCKNSEDNQGMVRMDDWLAQLSFSVIGRIVCGFQSDPKTGAPSRVEQFKEAINEASYFMSTSPVSDNVPMLGWIDQLTGLTRNMTHCGKKLDLVVESIINDHRQKRRFSRTKGGDEKDDEQDDFIDICLSIMEQPQLPGNNNPPKIPIKSIVLDMIGGGTDTTKLTTIWTLSLLLNNPHVLDKAKQEVDAHFLTKRRSTNDAAVVDFDDIRNLVYIQAIIKESMRLYPASPVVERLSGEDCVVGGFHVPAGTRLWVNVWKMQRDPNVWADPMVFRPERFLSDEQKMVDVRGQNYELLPFGAGRRICPGVSFSLDLMQLVLTRLILEFEMKSPGGEVDMTATPGLMSYKVLPLDVLLTHLSAS

SEQ ID NO: 288 - protein, 540 aa, Papaver bracteatum
MEFLMKLLLLLEPITFSIFLGIGSIVLLYNVFFLVINKKKKKKAPNASGAWPLIGHLNLFMNDKEALYKTLGTMADKYGPAFNVRLGNQEILVVSNWKMVKECFNTQNDKLFSNRRTTLGVKYMLNKKTSVAFSPYGTYWRELRKLTVQQLLSKQRLDSWKHLKIKEIDASFGRLNDLCSNNKGTGAATPIRMDSWFAELTFNVFARIVFGYQSGERLMLSGDTASNGERYKKTLEEAFLLMSSFAVSDVFPCLEWVDRSRGLVRSMKRFGDQLNSIAGCLIEEHRQKRSQSVSASNSTNDKGVGDEQDFIDVLLSVAELSQIPGDDPDLVIKSMILEALAGGSDTTTSTLTWVLSLLLNHPKVLKTAKEEIDMHVGRNRCVEESDIPKLVYVNAIIKESMRLYPNGSLVDRLTLEECEVGGFHVPAEGHLFVNVWKIHRDPSVWENPLEFKPERFLSNDCKVDMDFISQKYEFIPFGIGRRICPGMLSALQVMHFVVARLIHGFDMEAASADGKVDMAEKPGMTCYKMTPLEVMLTARQ

SEQ ID NO: 289 - protein, 548 aa, Papaver bracteatum
MYPVNQLQSQAIAVLCAVIVFIFYLGRKLFNSTHIHKPGKTAPEPAGAWPIIGHLHLLGGAKLMYRTLGSLADEYGPVFMVRLGMRRVLVISNTASARECFTTNDKVFATRPTTVAIKLLTYNHTMFGFAPYGPYWREIRKIATTELLSDRRLAMLKNVWISEINLCINELHQLLMDKNSRKVDHHQHVYNQNMDPISVEMNGWFADLSFNVVARMIAGKRYFGKNTDGGEEETRRYREAMNDFMHLVVILLVSDAVPFLGGLDFQGYKKRMKKTAKEIDYFLGKWVDEHRQRLKYKNISKVDQQDDFIDVLLLNLNDQPIYGRDTDTIIKSTCLSLIAGGSDTTAVTLTWALSLLLNNQHVLRKAQDELDIHVGRERQLEESDIKNLVYLQAIVKETLRLYPAAPLSAPRMAMEDCTVAGFQVSKGTQLMLNVWKLHRDPHFWGPDPLEFRPERFLTADGSSTGSGHCIDIDVKGRHYELLPFGSGRRMCPGVSFAMQVVHLTLATLLHGFHLSTPTDGPVDMTETSGLSCPKATPLEVLLTPRLPC

SEQ ID NO: 290 - protein, 567 aa, Papaver bracteatum
MDVAIIVDHHYLQPFVSIAGLLALLSFFYCIWVFIIRPRIIKSNLDERKLSPSSPPEVAGAWPIVGHLPQLIGSTPLFKILADMSNKYGPIFMVRFGMYPTLVVSSWEMSKECFTTNDRLFATRPPSAAGKYLTKALFAFSVYGPYWREIRKISTIHLLSLRRLELLKHGRYLEIDKCMKRLFEYWMEHHKNIISTTSSVKVNMSQVFAELSLNVVLKIIVGKTLFIKNGNEDYTKEEEEGQKLHKTILKFMELAGVSVASDVLPFLGWLDVDGQKKQMKRVYKEMNLIASKWLGEHRERKRLQIIQKRGAARGSNYDDGNDFMDVLMSILDEENDDLFFGYSRDTVIKSTCLQLIVAASDTTSLAMTWALSLLLTNPNVLQKAQDELDTKVGRDRIIEEHDIECLVYLQAIVKETLRLYPPAPLSLPHEAMEDCTVGGYQVKAGTRLVVNLWKLQRDPRVWSNPLEFKPERFLPQSDGGFGGEEARMDFRGQHFEYTPFGSGRRICPGIDFFLQTVHMALARLLQAFDFNTAGGLVIDMVEGPGLTMPKVTPLEVHLNPRLPVTLY

SEQ ID NO: 291 - protein, 558 aa, Papaver bracteatum
MQVDWPNILQKYYPIITCSLLTLLSFYYIWVSITKPSRNSKTKLPPPEVAGSWPIVGHLPQLVGSTPLFKILANMSDKYGPIFMVRFGMHPTLVVSSWEMSKECFTTNDKFLASRPPSASAKYLGYDNAMFVFSDYGPYWREIRKISTLQLLTHKRLDSLKNIPYLEINSCVKTLYTRWAKTQSQIKQNVGGAADDFVKVDMTEMFGHLNLNVVLRLVVGKPIFIQKDNADEDYTKDGHNKEELGQKLHKTIIEFFELAGASVASDVLPYLGWLDVDGQKKRMKKIAMEMDLFAQKWLEEHRQKGINHDNENDFMAVLISVLGEGKDDHIFGYSRDTVIKATCLTLIVAATDTTLVSLTWALSLLLTNPRVLSKAQDELDTVVGKERNVEDRDVNHLVYLQAVIKETLRLYPPSPLAVPHEAIENCNVGGYEVKARTRLLVNLWKIHRDPRVWSNPLEFKPERFLPKLDGGTGEASKLDFKGQDFVYTPFGSGRRMCPGINFASQTLHMTLARLLHAFDFDIESNGLVIDMTEGSGLTMPKVTPLQVHLRPRLPATLY

SEQ ID NO: 292 - protein, 571 aa, Papaver bracteatum
MMDLAMFIDQYFSLAKIAGLLALLSFFYYLWISTLWSPRNPKLSSVSPPEVAGAWPILGHLPQLLGSRPLFKILADMSDNYGPIFMVRFGMHPTLVVSSWEMAKECFTTNDRFLAGRPSGAANKYLTFALFGFSTYGPYWREIRKIATLHLLSHRRLELLKHVPDLEVTNCMKHLHRRWIDSQNQIKQNDAAAGSVKVDMGRVFGELTLNVVLKLVAGKSIFFKNDNTRQYDSKDGHNKEEEEGKKLHKTIIDFYSLAGASVASDVLPFLGWLDVDGQKKRMKRVAKDMDFIAAKWLEEHRHQKRQTVLSSSATLGSSNHDDAKDFMDVLMSILDGENDDLFFGYSRDTVIKTTCLQLIAAAADTTSVTMTWALALLITNPTILRKAQDELDTKVGKDRNIEERDINDLVYLQAIVKETLRMYPAGPLNVPHEAIADCNIGGYEVRAGTRLLVNLWKMHRDPRVWSNPSEFKPERFLPQLDGGSGGEAANLDFRGQDFEYLPFSAGRRMCPGIDFSLQTLHMTLARLLHGFDFNNDSAGIIIDMEEGSGLTMPKLTPLEIYLCPRLPAKLY

SEQ ID NO: 293 - protein, 543 aa, Sanguinaria canadensis
MEFLSLQFQPITIFALLLATPIFLYNLWNYGRKLNNKNKKSRKPPAPEASGGWPIMGHFHLFNGTEVTHRALGSMADKYGPAFNIRIGSHPTLVVSSWEIAKECFTTNDRLFSNRPGSLAIKLMFYDADSVGYAPYGTYWRELRKISTLKLLSNHRLETLKHLRTSEVESCFKQLHDLWRMNNKKGGSDDGSDFALVRIDNWFGDLTFNVVARIVAGKKNFAGGAASGDAGAQRYKEAMDEAFRLMTRFAFSDVVPSLGWLDKLTGLVGGMKRCGSEIDSIVASWVDEHRLKRISGKEGDDLEQDFIDVCLEILEHSTLPGDDPEVVIKSTCLDMILGGSDTTTVTLTWALSLLLDHPHVWKRAKEEVDAHVGKERQVEDSDIPNLVFIQAIVKETMRLYPAGPLIERRTMDDCEVGGFHIPGGTRLIVNLWKIQRDGSVYKEDPLEFRPERFLTSNAEVDLKGQNYELIPFGAGRRICPGVSFAVQLMHLVLARLIHDFEITMPMGAKVDMTESGGLISHKVTPLEVLLKPRLPSLQQAALY

SEQ ID NO: 294 - protein, 525 aa, Sanguinaria canadensis
MEYSSVLLHWFPASMAALLALVFLYNLIFNSPKTGNKKIIRRAPKAAGAWPVLGHLHLFGSGELPHKMLAAMAEKYGPAFTMKFGKHTTLVVSDTRVVKECFTTNDTLFANRPSTKAFDLMTYANDSVAFTPYSPYWRELRKISTLKLLSNHRLQSIKEVRVSEVSVCFRELYDICKNDGGGAPPVLVDMKKWFEEVSNNIVMRVIVGKQNFGSKIVCGEEEAVNYKNVMDELLRLASVSMLSDVAPLLGWLDMFQGHMSAMRRNGKKLDTILERWLEEHRKKKSEDEQDFMDVMLSIVEETKLSGRDADTVIKATCLAMIMGGTDTTAVSLTWIVSLLMNNRYALKKAREELDALVGKDRQVEDSDLKNLVYLNAVVKETMRLYPLGTLLERDTKEDCEVGGFHVEGGTRLLVNVWKLQRDPNVWNDPLEFRPERFLTENADIDVGGQHFELLPFGAGRRVCPGVSFALQFMHLVLARLIHGYELGTQNDEDVDLTESTEGHVNHKASPLDLLITPRLHPKLYE

SEQ ID NO: 295 - protein, 527 aa, Sanguinaria canadensis
MDYSSHLNQFYGVAPYMAALLIALVFLYNILWASPKTTNKKPIMAAGAWPILGHLHLFKDGELPHHMLKSMSDKYGPAFLMKFGQHRTLVVSNYRMVKECFTTNDTHFCNRPSTTAFDVMTYANDSVAFTAYSPYWRELRKISTLKLLSNNRLQAIKNLREAEVNVSFRGLYDLWKNNSDRAASVLVDMKKWFEEVSNNVVIRVIVGKHNFGTKIVKGEKEAVEYKTIMDELLRLASLSLLSDFAPILGWVDFFQGNVRKMKRNGKKLDVVLQRWLETHRRKKNSPEDEQDFMDVMLSIVEEGDKLSGHHADTVIKATCLAMIMGGTDTSAVSLTWIVSLLMNNRHALKKAREELDMYVGKDRQVEDSDLKDLVYLHAIVKETMRLYPLGTLLERETKEDCKVGGFHVEAGTRLLVNIWMVQRDPTVWSDPTKFIPERFLTEKADIDVGGQHFELIPFGAGRRVCPAVSFALQFLHLILARLIHGYELGTPNDADVDLTESPEGHVNHKASPLELLLTPRLDPKLYI

SEQ ID NO: 296 - protein, 535 aa, Sanguinaria canadensis
MNSIAVVGVLLFFLYYLWRTLFTTHKAAPPPQPAGARPIIGHLHLLGGANQLVHQTLGSMADKYGSIFMIRLGMRRVLVVSSSELAKECFTTNDKVFLNRPSSLALKLMAYNNAIFGFAPFGPYWRKMRKIAVTELLSNRRLEILKNIRISEINMSIKELHQLWVDMNSGDDQVGGPPIVVEMRKWFGDLSFNVVGRMIAGKRYFGRNCDCDEEETRRYQKAMGDFMHLVGVFVVSDAIPLLGFLDLQGYEKKMKRTAMDIDCVLGRWVDEHRRRRQDHDEKRIMVSDDDHQGQDFIDVMLSILNDDDQFYGYDADTVIKSTCLSLIAGGHETTAVTLTWALSLLLNNRHVLQNAQDELDIHISKERQVDESDIKNLKYLQAIVKEALRLYPALPLSALRLAMEDCTIAGFHVPKGTELMLNLWKLHRDPHVWSDPLEFKPERFLTNSTHEEVDVGGQHYELLPFGSGRRMCPGVSFALQVLHLTLARLLHGFHLSTPSGVPVDMTQSFGLSCPKATPLDVLLTPRLPSKLYYVA

SEQ ID NO: 297 - protein, 601 aa, Sanguinaria canadensis
MISTTPDVLATSSYSSSNKHMDSDHLYRFSTSTSIVIGLFILLFFLVLLWKPKKQSATSKTNKPTREQRAPEPSSSWPIIGHLRLFGGPNSLPHITLGAMADKYGPVFTIRMGSRPVLVVSSWETAKECFTTNDRVFASRPRTIAIKHMCYEHVMLGFAPYGSYWRELRKIVNRELLSNNRLELLKHVWGSEINTSIKELYELWLVNKNNIEAEGENEGTSDRVLVEMERWFADLTLNMSIKIVVGKRYPSGVTAGGSSGCDDDEAQRCRKALRDFFKLVGLFLVSDAIPFLRWLDLGGYEREMKTTARELDCLMEEWLEEHKMKRRLLISPSAGDHHEAAEIMINKQKEAELQEYDFMDVMLSILDDDIEGKNLSDYDVNADTINKSTCLNLILGGSDTTMVTLTWALALLLNNPHVLQKAQDELDIHVGSKRQVDDSDMKNLIYLQAIVKETMRLYPAGPLSVPHESTEDCTVAGYHVPAGTRLIVNTWKIQRDPRVWSNPSEFKPERFLTDSHVDIDVRGRNFELIPFGSGRRSCPGTSFALQVVHLVLARLIHGFEFKTPSEAPIDMTESVGLSNFKATPLDVLLTPRLPSQLYYVS

SEQ ID NO: 298 - protein, 525 aa, Sanguinaria canadensis
MDSTLVFIGLFALLLVYPLLLRRSVLKSTSNTNKTTYKSKNQAPEAAGAWPIIGNLHQLAGGGNCLHKTLGAMADKHGPAFTIRMGLHKALVVSSWELAKECFTTNDVVFMSRPHQVAIKHMGYSTAMFGIAPYGPYYREMRKIVTQELLSNRRLELLKHVWASEINNSIKQLYEKVEGGPVLIEMKRWFADLTLRTTVKVICGQQQFGGDDDDDEAGRFQTALRDFFRLLGHFRVADVIPVLEWLDFQGYKKEMENNGRVLDNLMNKWLEEHKRKRKNGGTEEDFMNVMISKLLDDTKMLSYYDADTINKSTCLTLILGGSDTTMVSLTWALSLLVNHPHVLKKAQEELDVHVGKERQVDDSDLWSLTYLQAIIKETLRLYPPGPLSAPRESTDNCTIAGYHVPAGTRLIVNTWKIQRDPRVWPDPLEFKPERFLTTHVDVDVKGQNFELLPFGSGRRACPGASFALRVLRLSLARLIHGFDFKTPLDDSPIDMVESGGITNVKDTPLEVLVTPRLPSSLYVCK

SEQ ID NO: 299 - protein, 532 aa, Sanguinaria canadensis
MDFDLYQFSKPTIFIGGLFAILLYFVLKKSSTPKSKSKLEQPPEPAGAWPIIGHLPLLGGPDLPHITLGKLADKYGPAFTIRIGVHKAVVINSWEVAKECFTTNDKAFSSRPRQVAMKHMGYDYAMFGFAPYGNYWRELRKIVNREVLSHSRIESLYHVWGTEINTSVKELYELWGKKSTGSGGAPVLVEMKRWFSDMTLNMSVMMVAGKRYNFSGNKADDEAGRCQDGLRNFFRLVGLFVPSDALPFLAWLDIGGYEKEMKKVAKELDVLVQEWLEEHKEKRLALTAAGKKGSENDFMDVMMNILEDQKLSEFDADTINKATCLTLILGGTDTNMVNLVWALTLLVNNQDALKKAHDELDFHVGKDRQVEESDVKNLVYIQAIMKETLRLYSGPLSGLRESTEDCTVAGYYVPAGTRLIINAAKIHRDPRVWSDPTAFKPDRFLTEQKEMDVRGQDFEILPFGAGRRICPGVSFALQVLPLALARLIHGFDFKTPTDAPIDMTESPGLTNAKSTPLEVLVSPRLTSKLYGC

SEQ ID NO: 300 - protein, 555 aa, Sanguinaria canadensis
MDSILNQFISKPTMVICSLFALLSLYFLLIKRSTTKSKLQLPPEPAGAWPVIGHLHQLGGPNLPHITLAAMADKYGPIFTMKIGTYRALVVSSPEVAKEIFTTHDRIWATRPNQAAMKHLGYDSAMFGFAPYGPYWRELRKLVNRELLSNTRLDLLHHVWDSEINTSIKELYDSLATKNNAKGRGTGGAGSTGPVLVEMKRWFADLTLNITVRMVAGKRYFGANKTSSTSTDQCDNEKGDSKAWKCQRELRNFFRLVGLFVVSDALPFLGWLDLGGHEREMKNTARELDVLVQGWLDEHKRKRSLSVAEGGEKINGEQDFMDMMLSTIDDAKLSGYFDADTINKSTCLNLILGGSDTMMVNLIWPLTLLVNYPDELKKVYDELDTHVGRDRQVDESDIKNLVHLKAVIKETMRLYTGRITGLRQSSEDCTVAGYHVPAGTRLIVNTWKISRDPRYWSDPLEFKPERFLTTHADIELTGQNFELIPFGSGRRSCPGASFAIQLLHLALARLVHGFWFERPSDAPIDTSECPGLTNFKATPLEVLATPRLPSKLYVG

SEQ ID NO: 301 - protein, 538 aa, Sanguinaria canadensis
MDFILNQFISKPTMVLGTLFALLSLYFLLIKRSTTKSKLQLPPEPAGALPIIGHLHLLGGPNPPHITLANMAEKYGPIFSIKMGLKRALIVSSSEVTKECFTTHDLNFVSRPRHAAMKLMGYNFATFGFAPYGPYWRELRMIINRELLSQTRILSLEHVWGSEINESIKELYDLLTRKGGGGGGPVVVEMKRWFADLTLNIAVKMVCGKRYFGVNSPSTSTTRDVQEDDEARRCQKGMRNFFRLLGQFVVSDSIPFLGWLDLGGYQREMKNTARELDDLMQGWLEEHKKKRLERKTAAGEQDFMDVMLNILEDGKLSQYFDTDTINKSTCLSLILGGSDTTMVNLVWAFSLLVKHQDALKKTRDELDIHVGRERQVEESDIKNLVFLQAVVKETFRLYAGPISGVREAAEDCTIAGYHVPAGTRLLINSWKIHRDPRVWSDPLEFHPERYLEARHADIDVKGQNFELAPFGMGRRVCPGSAFGLQVLHLTLARLIHGFEFKTPSDAPVDMTESVGMSIIKATPLEVLVTPRLPSELYV

SEQ ID NO: 302 - protein, 533 aa, Sanguinaria canadensis
MDISNLYELYYFSTPTLFVGGLFVLLLIYSLFSSRPGIKSKLQQPPEPAGAWPLIGHLPVLSGPELPHVALGKLADKYGPVFTIRMGVHKSLVVSDWEVIKECFTTHDKVFSSRPCQVAMKLMGTAMFGFSPYGNYWRELRKIMNREVLSHGRIESLYHVWGSEINTSVKELYDLWAKKNNGGGPILVEMKRWFSDLTLNMSVMMAAGKRYNFGDDSSTTNDEAARCQHALREFFRLVGLFVPSDALPYLGWLDIGGYQKQMKKVARELDDLMQVWLDEHKKKRLAAKAEGKKGGEQDFMDVMMTILEDGKLSDYYDADTINKATCLTLILGGTDTNMLSLVWTLALLMNNRQALKKVHEELDIHVGRERQVEESDIKNLVYLQAVIKEEMRLYSGPLSGLRETTEDCTIAGYHIPAGTRLIINASKLHRDPKVWSDPLEFKPERFLTENVGVDVRGQNLELQPFGAGRRICPGVSFALQVLPLTLARLIHGFELNTPGDAPIDMTESPGLQNAKLTPLEVLITPRLPSKLYV

SEQ ID NO: 303 - protein, 535 aa, Sanguinaria canadensis
MIVIGAFLALVVLVVYYNLLLRRPALLKFKNMKQQAPEAASAWPIIGHLHNLAGGIGGNGLLHEKLGAMADKHGPAFIIRLGLHKALVVSSWEVVKECFTTNDVALISRPHQVASKHMGYGMAMFAFASPYGPYWRELRKIVKQELLSNSRLELLKHVWASEINTSIKQLYEKVKEGGGLPVLVEMKGWFADLTLKMTVKVICGKRHFRVAGNVGDHVDADDDDEVIGGRFEKALRDFFRLLGDIRVVDVLPFLRWLDFGVGYKKEMENNGRVLDILMEEWLQEHKRKRMNGGTEEDFMNVMISKLLNDTKLLSYYDADTINKSTCLTLILGASDTTMVTLTWALSLLVNHPQVLKRAQDELDVHVGRERQVEDSDIQNLTYLQAIIKETLRICPPGPIQAPHEAKDDCTVAGYHVPAGTRLIVNTWKIQRDPRVWPNPSEFKPERFLTTHVGVDVRGHNFELIPFGSGRRSCPGTSFALQVVHLTLARFIHGFEFKTPSDAPIDMTESGRITNVKATPLEVLVTPRIPPSGLYV

SEQ ID NO: 304 - protein, 572 aa, Sanguinaria canadensis
MDLLIFSSQLQGTVGLLALLTFSYYVWILIIKRIKTTNTLKVMNKVAAAAAPEVAGAWPIVGHLPQLVGPQQLYRILGDMADEYGPIFMVRFGMYPTLVVSSWEMIKECFTTNDRFLASRPSSAAGKYLTYDFAMFGFSFYGPYWREIRKISTLELLSHRRLELFKNVPFTEIDTCIKRLYQLWRVKNNDHPAAAPVIKVDMSQLLRDLTLNTILKLVVGKNLFNEKDHGEQEEGRKLHLHKTIVEFFKLAGVSVASDALPFLGWLDLDGQKKKMKRIAKEIDLIAERWLQEHQEKKSLSNKKLLAAGGGKVDGHDDFMDVLLFILDDDSQFFNFSRDTVIKATSWAMILTAADTTSVSMTWALTLLLTNPRVLRKAQDELDMKVGRDRHVEERDIENLIYLQAIVKETLRLYPAAPLGVPHEAIQDCTVAGYQVRAGTRVLVNLWKLHRDPRVWSNPSEFRPERFLIDDIDEQGGGGGGGGGESTAKDFRGQHFEYIPFGSGRRMCPGINFALQIVHMTLARLLHAFELRTTTSASLMDMTEESGLTMPKKTPLVVLLQPRLPLPLYDHHE

SEQ ID NO: 305 - protein, 533 aa, Stylophorum diphyllum
MEFLSLQHQLISIFALLLASIFLYNLLKNHGRKSKTSKPPAPEASGGWPIMGHLNLFNGSELTHQALGSMADKYGPAFNIRFGSHQTLVVSSSEIVKECFTTNDRFFSNRPGSLAIKLMFYNADSVGYAPYGAYWRDLRKISTLKLLSNHRLETLKHLRTSEVESCFKQLYNQWKNNKVGGDHDFALVRMDNWFGDLTFNVVARIVAGKKNFAGGATNGDVGAQRYKEAMDEAFRLMTIFAFSDVVPSLGWLDKLRGLVGGMKRCGAEIDSIVAGWVDEHRLKRASGKGGGHTDLEQDFIDVCLEIMEHSTLPGDDPEIVIKSTCLDMILGGSDTTTVTLTWALSLLLNNPHVLKRAREELDTHVGKDRQVDDSDMSNLVYIQAIIKETMRLYPAGPLIERRTSEDCEVGGFHVPAGTRLLVNLWKMQRDGSVYKEDPLEFRPERFLTSNADVDLKGQNYELIPFGAGRRICPGVSFAVQLMHLVLARLVHGFEMKTAGDAKVDMTESAGLISHKVTPLEVLLKPCLAIQQAL

SEQ ID NO: 306 - protein, 533 aa, Stylophorum diphyllum
MDSFLLIQWFAASMAALLAFVFLYNLVWSSSRTTKGKNIRKAPMAAGAWPILGHLHLFGSGELPHKMLSTMAEKYGPAFTMKFGKHTTLVVSDTRIVKECFTTHDTLFANRPSTTAFDLMTYANDSVAFTPYGPYWRELRKISTLKLLSNHRLQSIKEIRVSEVNVCFRELYESCKSKTDATPVLVDMKKWFEEVSNNIVMRVIVGRQNFGSKIVQGEDEAVNYKKVMDELLRLASLSMLSDVAPVLGWLDMFQGNKSAMKRNAKKVDTILEGWLEEHRMKKSASGISSAGENDQDFMDVMLSIIEETKLSGRDADTVIKATCLAMIMGGTDTTAVSLTWIVSLLMNHRHVLKKAREELDALVGKDRQVEDSDLKNLVYMNAIVKETMRMYPLGAMLERETKEDCEVGGFQVQGGTRLLVNVWKLQRDPNVWTDPTEFKPERFLNENADIDVGGQHFELLPFGAGRRACPGVSFALQFMHLVLARLIHGYELGTQNDADVDLTESTEGHVNHKASPLDLLLTPRLNNPNLYDY

SEQ ID NO: 307 - protein, 568 aa, Stylophorum diphyllum
MTIGALALLSFIYFLRVSVIKRTKYTNTAVTATNKLENDEDEANHSKRVVAPPEVAGAWPILGHLPQLVGLKQPLFRVLGDMADKYGPIFIVRFGMYPTLVVSSWEMAKECFTTNDRVLASRPASASGKYLTYNYAMFGFTNGPYWREIRKISMLELLSHRRVELLKHVPSTEIDSSIKQLYHLWVENQNQNKQGDHQVKVDMSQLLRDLTLNIVLKLVVGKRLFNNNDMDHEQDEAARKLQKTMVELIKVAGASVASDALPFLGWLDVDGLKRTMKRIAKEIDVIAERWLQEHRQKKLTSNDKGGSNNIQGGGGDNDFMDVMLSILDDDSNFFINYNRDTVIKATSLTMILAGSDTTTLSLTWALTLLATNPGALRKAQDELDTKVGRDRQVDERDIKNLVYLQAIVKETLRMYPAAPLAIPHEATQDCIVGGYHVTAGTRVWVNLWKLQRDPHAWPNPSEFRPERFLAVENDCKQQGTCDGEAANMDFRGQHFEYMPFGSGRRMCPGINFAIQIIHMTLARLLHSFELRVPEEEVIDMAEDSGLTISKVTPLELLLTPRLPLPLYI

SEQ ID NO: 308 - protein, 527 aa, Stylophorum diphyllum
MAALLPLAFLYNIFLASSSKATSKRTISTKKPPMVAGAWPILGHLHLFKEGELPHQMLKSMADKYGPAFLMKFGQHQSLVVSDYRIVKECFTTNDTLFCNRPSTTAFDVMTYANESVAFTEYSPYWRELRKISTLKLLSNNRLQAIKNLREEEVDVSFKGLYDSWKNKNNKSTAGSVGDERAPVLVDMKKWFEEVSNNVVIRVIVGKCNFGTKIVQGEKEGVEYKTIMDELLRLASLSLLSDFAPILGLLDFFQGHVRTMKRNGKKLDVLLQRWLEEHKRKKSTPEDEQDFMDVMLSIIEESKLSGYDADTVIKATCLAMIMGGTDTSAVSLTWIVSLLMNNRQALKKAREELDAQVGKDRQVEDSDLKNLVYLNAIVKETMRLYPLGTLLERETKEDCEVGGFHLEGGTRLLVNVWMVQRDPDVWTDPTKFIPERFLTEKADIDVGGGNFELIPFGAGRRVCPGVSFALQFLNLVLARLIHGYELGTPEDADVDLTESPEGHVNHKASPLELLLTPRLSNPKLYDY

SEQ ID NO: 309 - protein, 547 aa, Stylophorum diphyllum
MDSDHQLLSYQFSASNMFISLFAFVLYYLLVWRPTKSNLKMKTISSEDKQAPELAGSWPVIGHLHLLHGPNPLHVALGAMADKYGPAFTVRVGVHRTLVVSSWEVAKECFTTNDKVFVSRPRQAAGKHMGYNNAMLRFASDTPYWTQIRKMLKRDLLSNNRIELLNHAWHSEINTSIKELYEMNWSSGEGRRGGIRPPVSVDMKQWLGDLTLNMSVKMIAGKRCFGSGVSACDEGEARRCQKGLKDFVRLMGQIVVSDAIPFLGWLDLDGYEGEMKRAGKELDRLLGGWLEEHKMKRSPGDEASAQKDWMDLMLSVLGDGKLDGYYDADTINKATCLALLQGGSIWTMLTLLWAFALLVNHPHVMKKAHDELDNHVGRERQVEESDIKNLTYLQAIVKEAMRLYSVSMRLLESTADCTVSGYDVPAGTRLIVNTWKIQRDPRVWSDPSEFHPERFLTHRHRDMDLYGQNFEITPFGSGRRSCPGSSLGLQMVQLTIARLLHGFEFKTPSDAPIDMTESVGVENMVKATPIEVLLTPRLLDEVYAFYN

SEQ ID NO: 310 - protein, 561 aa, Stylophorum diphyllum
FCQFQGIVGILLAFLTFLYYLWRASITGLRTKPKHNDFKVTKAAPEADGAWPIVGHFAQFIGPRPLFRILGDMADKYGSIFMVRFGMYPTLVVSSWEMAKECFTTNDRFLASRPASAAGKYLTYDFAMLSFSFYGPYWREIRKISMLELLSHRRVELLKHVPSTEIDSSIKQLYHLWVENQNQNKQGDHQVKVDMSQLLRDLTLNIVLKLVVGKRLFNNNDMDHEQDEAARKLQKTMVELIKVAGASVASDALPFLGWLDVDGLKRTMKRIAKEIDVIAERWLQEHRQKKLTSNDKGGSNNIQGGGGDNDFMDVMLSILDDDSNFFINYNRDTVIKATSLTMILAGSDTTTLSLTWALTLLATYPLCALRKAQDELDTKVGRDRQVDERDIKNLVYLQAIVKETLRMYPAAPLAIPHEATQDCIVGGYHVTAGTRVWVNLWKLQRDPHAWPNPSEFRPERFLAVENDCKQQGTCDGEAANMDFRGQHFEYMPFGSGRRMCPGINFAIQIIHMTLARLLHSFELRVPEEEVIDMAEDSGLTISKVTPLELLLTPRLPLPLYI

SEQ ID NO: 311 - protein, 522 aa, Tinosporia cardofolia
MDLPQPTISTTLLAFFSILLFIICYRLLSTKSDKRSSSSRNKPLDAPGAWPVIGHLHLLNGVIQHEILGTMADKYGPAFTIWLGTRPALVVSNWEVAKECFTTCDKALASRPPSLALKIMGYNDALFAFAPYGQYWRELRKIVMIELLSSRQLDSLKHVWDSEIDSCIEDLYEKCKGHRETVLVNMKQWFADLMMNVVVRMVVGKLNFGKTKEGDDEVAKAHQGQLKAMREFFKWVDVFMIEDAFPILTWLDPQGYQRKMKNIAKDLDSLVQGWLDEHKLKQKTGDNGKKDFMDIMLSAVKDASISDRDDETICKATCLNIILGASDTTTVTLTWTLSLLLNNRHVLRKAQEELQAQVGKHRCVEESDVKNLVYLHAIIKEVLRLYPAVPLLGPRESVADTVVAGYHIPAGTRLIVNLWKIHRDPLNWPDPLEFRPERFLTTHKDTDVWGQNFELTPFGSGRRICPGISFALQVIPLTLARLLHGFELTTPGSAPVDMTESTGLTNLKATPLDVFISPRLVL

SEQ ID NO: 312 - protein, 526 aa, Tinosporia cardofolia
MESIPTAINVLLAFVSIYYLLKFRKKIITTTRDIKKIKAPELKGAWPIIGHLHLFRSDDLLHRKLGAMADELGPAFMIRLGMRPALVVSNWQTAKECFTTKDRIFATRPDSVAAKHMGYENLILGFTRYGPYWREVRKIVTLELLSSHRLHLLRHVRISEIDMSIKKLHQLCTSNDNKYSSVVVDLNQWFKALTLNIIVRIIAGKRYYGGDLEDDEESRRWKKALNEFMHLFGIFSVSDAIPQLQGMDVQGHERVMKRTGKDIDVILSKWLEEHRRKKIRVNREGAEKDFIDIMLDLIKENVNISGHDADNVVKATCLALVSAGSDTTMITLTWAVSLLLNNHRVLEKAQAELDNQIGINRVHVEEEDIKNLPYLQAIVKETLRLYPAAPFSLPHEAMEECTVAGFHVPKGTRLITNIWKLQRDPQVWEDPLEFRPERFLTSDRRHVDFRGQHFELIPFGSGRRMCPGISFAIGVLHLTLARLLHEFHLGTPTNAPIDMNENPGITLEKADPLHPLVSPRLTSINY

SEQ ID NO: 313 - protein, 538 aa, Tinosporia cardofolia
MDSQLTSFQSKPSAYLIAALLALVSAYYLIIKKKSRATYQDNYGKIRAPEPKGAWPIIGHLLLFKPNDVLYQKLSSLADELGPAFMIRLGMRSALVISNWEIAKECFTTNDRIFATRPKLMASKHMGYGGAEVGVAPYGPYWREVRKIITVELVSNHRLNLLKDVRISEIDMSLKELYDLCMKKKKNGSGEESSRVELDLYQWFKDMSLNILVKLIAGKRYYGVAAAANEDEESRRWKKATEESVFLFGQFVVGDAIPLLEGVDVQGLERAMKKTGKEIDAVLSKWVEEHRMKKQQLNGARDEQDFIDVMLNIIKDGKISDHDADTIVKATCMSLVQAGSDTTMLTLTWAVCLLLNNCNVLEKAQAELDDQIGRSKGRIVEEDDIKKLPYLQAIVKETWRLYPPAPLAVPREAMEDCTVAGFHVPKGTRLMTNIWKLHRDPKVWDDSLKFRPERFLSSEHAHVDFRGQQHEFMPFGSGRRMCLGMPLAIGVVHLTLARLLHEFELATPSNAPVDMSEKAGLTLVKATPLNVLIAPRLC

SEQ ID NO: 314 - protein, 531 aa, Tinosporia cardofolia
MDSIILQSNLLTTVIIITSFGLFVLSFYYVLWKAIRTGNKRNCSNPKAPEAAGGWPILGHLHLFRGQGLLLHKIFGAMAEKHGPAFTIRLGMRPALVVSNWEVAKECFTANDRALASRPTSLALKIMGYNNSLFAFAPYGQYWRELRKIVMHQLLSSRRLELLKNVWLSEIDIWIKGLYENSLVNKVVDMKQWFGELMMNIVVRLVAGKRSFGKIREGDSEEAKAHQRQIKALRDFFRLVEVFMIEDAFPFLTWLDPRGYQKEMKNIAKELDYLLEEWLEEHKLKQQAACDDQSKDFMDVMLSEVKDSTITERDANTICKATCLNVILGASDTTTLTLTWALSLLLNNRHVLKKAQEELNAQVGKDKQVEESDMKNLVYLHAIIKEVLRLYPAAPLSVAHESLEDTVVAGYHVSKGTQVIFNLWKIQRDPSVWSNPLEFQPERFLTTHKHVDIWGQNFELIPFGSGRRMCPGVPFALQVVSLTLARLLHGFELTTPGGAAVDMTETPGLTNMKATPVEVFLRPDLPHQLYA

SEQ ID NO: 315 - protein, 524 aa, Thalictrum flavum
MPSQTIQIIMDFFHQCVATILFCVLASPFFFYYLLPWWKNANDHDLAKSRGKPVPEVDGAWPIIGHMHMLQPSDSFYSSLAEKYGPIFTLRIGLCKTIVINSWELAKECCTTHDRVFASSPEATAAKILGYDYAMFGRNPYGPYWREMRKIIITELVSNRRLELLKHIRVTEISTSIQELYQLWEARSSKNVKERVVVDMQKWFGDLMLNIGVEMVAGKRYFGASSNEDKEEARQLHKTFKDFSNLFGVPVLSDAIPFLRWLDYKGHIKAMKRCAKQVDCILHRWLEEHKQNKTTIAGDFMDILLSVLQDKEIFGRDADTVIKATCLNMMLGVVETNKVTVTMALISLLNNRRILKKAQEEIDIHVGSDKQVEESDIEKLVYLQAIVKETLRLYSPGLGTREPSEDCTISGFHVPKGTEVMVNVQQIHRDPSIWSNPLEFQPERFLTTQANIDFGGQHHEYIPFGAGRRLCPAISFAVLVVHLTLARLLQGFDFATPKDAPVEMNESVETLEVLITPRLPLHMY

SEQ ID NO: 316 - protein, 534 aa, Xanthoriza simplicissima
MHNPIPNQWLPSSTLLTPIIVSFLVIVLFYIYKKRSSNTIRTKKAPEVVGAWPVIGHLNLFSCPKPGHIVLGELADQYGPAFTIHFGMHPTLVVSSSELVRDCFTTNDKLFSSRLVNKAIKYMFYDQDTISFAPYGPYWRELRKMIALNLLNNERIKMLQQQRISEMDACLKKLYDLSAKRKDENAGVLVDMSKWFAEISFNVVTRIVAGKHIFGPKVERYKNVMEEARRLMDVMVFSDMVPYLGWLDRLRGVDSAIKRTAKELDSVLESWVEEHRRKSVSISAGTGGIFNIKEEEELDFIDIMLSIIAKNNLPGDDPDTLIKAIVQETYLAAWDNTTVTLTWVLCLLLNNKQVLKRAQNELDAQVGKERQVEDSDINNLPYVQAIVKESLRLYPPGPIIERATTEDCNVGGFRVPAGTRLWVNLWKLQRDPKVWPNDPLEFRPERFLNDNADIDLRGQNSELIPFGSGRRMCPGVSFSLQVIHLVIARIIQGFELKAPTDADIDMSTTLGMISWKATPLEVLMNPRFPPVFYK

SEQ ID NO: 317 - protein, 550 aa, Xanthoriza simplicissima
MSTLQISILTVKSPYSQMHYYPLLHQWLPASMALVSLLVIILFSIFKKRSSKMIKAKKAPEVAGAWPLIGHLNLFSGPKLLHLVLGELTDQYGPAFMIHLGMYPTLVVSNWELLKDCFTTNDIFFSNRPVNKAIKHMFYNKESIGFTPYGSYWRELRKMTTLKLLSNHRLDLLKPLRISEMDACFRNLYELWTKDKDGNAWLLVDMSKWFGEISFNVVARIVAGKKNFGSKGDRYKTVMEEVVRLMGLRALSDAVPYLGWLDQLRGLDSAMKRAAKELDSVLESWVEEHRLKRVSVSAGTGSTVKTAKEEEEEEDFIDITLSILAENQLPGDDPDTGIKSLILDMILGGSDTSTVTLIWAMCLLLNNVHVLKRAQYELDAQIGKERQVEDSDIKNLPYIQAIIKETMRLYPAGPIIERQANEDCDVGGFHVPAGTRLWVNLWKLQRDPNVWKDDALEFRPERFLTDHADIDLKGQHLELIPFGSGRRICPGISFALQVMHLALARIIHGFELKTPNDSNIDMSGTPGLLCCKATPLQVLLTPRFNPMFYK

SEQ ID NO: 318 - protein, 520 aa, Xanthoriza simplicissima
MDSLRHCLGGILALLIFLGYLQWKRGTSNKCIEAPQPDGAWPIIGHLPRLMKPQIMHRTLSTMADKHGPAFTLRLGVHKTLVVSSWEVAKECFTTNDRVFATRPTSIAVEILGYNYALFAFGPYGSYWREARKIAILELLSNHRLELLKHVRISEVSTSIRELYQVWKENCDIANGSALVDMKPWFGDLTLNVVVRMVAGKRYMGGSVKSDDVEGRRFQKATKDLFDLFGLFILSDALPFMGWLDLHGHKKAMKKTAKELDSIMQRWLEEHRQSLLDDGTKEEKKDFMYVMLSILEDKKLFQYDADIVNKAICMNMIMAGTDTQMITLTWVLSLLLNNRHILKKAQDEIDSSVGKDRQVEESDIVKLVYLQAIVKEALRLYPPAPLSAQHEAMEDCTVAGYYVPAGTRLITNIRKIQRDPRVWSDPFEFHPERFLTNQANVDFRGQSFEFIPFGSGRRMCPGISFALQVVHLTLARILQGFDFETPMNASVDMTEAPGLTNVKSTPLQVLITPRLHPNLY

SEQ ID NO: 319 - protein, 523 aa, Xanthoriza simplicissima
MDLLNPYFATIFGGFFALLIFLFIISQKRSRIPKIRAAPEPVGAWPIVGHLPMLLGPRLPHFVLGDLGEKYGSAFTLRLGIHKTLVVSSWEVAKECFTTNDQVFATRPSFMAAKIMGYNYALFGLAPYGSYWRELRKISIIELLSSHRLELLKHVRVSEVSTSMKELYEVWAENCSNGNGSVLVEMQRWFGDLTLNISVRMVAGKRYFGTSASLDDDEARRISKATKDFFRLTGMFVVSDSVPFLWWLDFQGHEKAMKRTAKEMDDIFGGWLEDHRRNKLAGGTKVQQDFMDVMLSILEDEKFFGYNADVVTKATCLNMLLGGTDTTMVTLTWALSLLLNNRHILKKAQTEINTHVGKDTQVDESDIVKLVYLQAIVKETLRLYPAAPLSTPHEATKDCTIAGYHVTAGTRLITNIWKIQRDPRVWSNPSEFQPERFLTDQANVDVRGQHFEFIPFGSGRRSCPGISLGLLVVQLALARLLQGFDFETPSDALVDMTESAGLTNLKATPLHVLITPRLHSSLY

SEQ ID NO: 320 - protein, 530 aa, Xanthoriza simplicissima
MDSVHQGQYLPTPMVSVFVFFISLYFLIVWKTRSSSKTNTCNEVPEAPGAWPIIGHLHLLGGSELPHKTLGAMADKYGPIFKIRIGVHQALVVSSSDIVKECFTTNDKVFASRPTSTASKILGYDYVMFGFSPYGPYWIELRKIIMSELLSNRRLELLKHVRDSEIDISIQELYKVWKNHDKSKGPILVDMKQWFGDLALNVILRMIAGKRYSGSIFSSDETEARRCQKGARDFFRLLGLFIIEDALPYLSWFDLQGYKKEMKNTAKELDSVFQRWLEEHKRTRETGELNREQDFMDILMSTLEETKISEYDNDTIIKSTCLSIVTGGNDTTMVTLTWILSLLLNNKHALKKVQDELDSHVGKHRHVEESDIKNLIYLQAIMKEALRLYPAGPLSGPRVADADCTLAGYHIPAGTRLLVNTYKIQRDPLVWSEPSEFRPERFLTSHVNMDVKGLQYELIPFGTGRRACPGMLFALQVVPLVLARFLHEFEPKTEMDMPVDMTETAGLSNAKATPLEVVITPRLQPELYSL

SEQ ID NO: 321 - protein, 528 aa, Xanthoriza simplicissima
MDFTMIIQWLLTSFAILVAFVLIWSSATRSSTRKRNKTAPVAAGALPIVGHLHMLMGRELPHRLLSNMADKYGPAFMMKYGLQPALVVSSLKLTKECFVHNDRAVFKRPRSKALKNLTYDQASLGFAPYGPLWVEMRKVSKTNLLSNQRLQMQRHVRASEVDAFIKELYDLWSSKSNNIKGAPLLVEMNKWFEELALNVVTRMLSGKRHIGFKARRGEDSESMHYKKVVVDATLLTAKLVVSDFFPSLGLVDYLQGDESSIKGTSKELDAILATWVEEHRHKKVSGSEDDEKDFIDLTLSMIDQTQHQGADVDTFIKSMCVGMIFGGSDSTSVALAWALSILMNNRPVLKKAREEIDRQVGRDRKVNDLDVLKLDYLKAIVKESMRLCLVGPLLERVAVEDCEIGGYHVKAGSRVVVNIWKMQHDPNLWSDPLEFQPERFLTTNANVELRGQHFELLPFGAGSRICPGITFALELIQLTLARLIHGFELGTPMDADVDMTETSSVTNYRATPLEILLTPRLDPKLYNY

SEQ ID NO: 322 - DNA, 2703 bp, Papaver somniferum
atggagctccaatatatttcttattttcaaccaacttcctccgttgttgctcttctacttgctcttgtatccatcttatccagtgtcgttgttttgaggaagacatttttgaataactactcatcatcacctgcatcatccacaaaaacagcggtactttctcatcagcggcagcagtcgtgtgcattgccaatttccggtctcctccatattttcatgaataaaaacggcttaattcatgtaactcttggaaatatggctgataaatacggtccgattttcagtttcccaacaggtagccatagaactctcgttgtgagcagttgggagatggtaaaagagtgttttactggcaacaatgacactgctttctcaaaccgtcctatcccgttagcttttaagactatattctatgcatgcggtggcatagactcatacggtctttcgagtgtaccttatggaaaatattggagggagcttcgaaaggtctgtgtgcataacctcctgtctaatcaacaactactcaagttcagacacttgataatttctcaagtcgatacgtctttcaataagctgtatgagttatgcaaaaactctgaagacaaccagggaaactatcctactactactaccgcagctggcatggtgagaatcgatgattggctcgccgaattatcgttcaatgtgataggaagaatagtctgcggattccaatcaggccctaagacaggtgctccaagcagggtggaacaatttaaagaagcaattaatgaagcatcttattttatgtcgacatctccagtgtcagataatgttccaatgctagggtggattgaccaattgacaggtcttacgagaaatatgaagcactgcggaaagaaattagacttggtggtcgagagcataattaatgatcatcgtcaaaagagacgattctctagaactaaaggaggagatgagaaggacgatgaacaagatgacttcatcgacatttgtttgtcaataatggagcaaccacagcttcctggcaacaataatccttctcagatacctatcaaatctattgtcctggacatgataggtgggggcactgacaccacaaaactgaccaccatctggaccctttccttgctgctgaacaacccccatgtgttggacaaggcaaaacaagaagtggatgcacactttcgaaccaaaaggagatcaacaaatgatgcagcagcagccgtggtggattttgatgatattcgtaaccttgtctacatccaggcaatcatcaaagaatcaatgcggttgtatccagccagccccgtggtggagcgactgagcggcgaagattgtgtggtcggtgggtttcatgtaccagcagggacgagattatgggctaacgtatggaagatgcaacgagaccctaaagtatgggatgatccattggtgtttcgaccagacagatttttgagcgatgaacagaagatggttgatgtaaggggtcaaaattatgagctgttaccatttggagccggtcgacgtgtatgtccaggtgtatccttctctttggatctaatgcaactggtactgactcgtcttattctcgagtttgaaatgaagtctcctagcgggaaagtggacatgacagcaacaccaggattaatgagttacaaggtgatcccccttgacattctgctcacccatcgtcgcataaagccgtgtgtgcagtcagcagcctctgagagagacatggagagtagtggtgtaccagtaatcactctgggctcgggcaaggtgatgcctgttctgggcatgggaacatttgagaaagttggtaaagggtccgaaagagagaggttggcgattttaaaagcgatagaggtgggttacagatacttcgatacagctgctgcatacgaaactgaagaggttcttggagaagctattgctgaagcacttcaacttggcctagtcaaatctcgagatgaacttttcatcagttccatgctctggtgcactgatgctcacgctgatcgtgtcctcctcgctcttcagaattcgctgaggaatcttaaattggagtatgtggatctatatatgttacccttcccggcaagcttgaagcctgggaagataacgatggacataccagaggaagatatttgtcgcatggactacaggtctgtatgggcagccatggaagagtgtcaaaaccttggcttcactaaatcaatcggtgttagcaatttctcctgcaaaaagcttcaggaattgatggcgaccgccaacatccctccagctgtgaatcaagtggagatgagcccggctttccaacaaaagaagctgagagagtattgcaacgcaaataatatattagtcagtgcaatctctgtactgggatcaaacggaaccccatggggctccaatgcagttttgggttctgaggtgcttaagaaaattgctatggccaaaggaaaatctgttgctcaggttagtatgagatgggtttacgagcaaggcgcgagtcttgtggtaaaaagtttcagtgaagagagattgagggaaaacttgaacatatttgactgggaactcactaaggaagaccatgaaaagatcggtgagattccacagtgcagaatcttgagtgcttattttttggtctcacctaatggacctttcaaatctcaagaagagttgtgggatgatgaagcttga

SEQ ID NO: 323 - protein, 900 aa, Papaver somniferum
MELQYISYFQPTSSVVALLLALVSILSSVVVLRKTFLNNYSSSPASSTKTAVLSHQRQQSCALPISGLLHIFMNKNGLIHVTLGNMADKYGPIFSFPTGSHRTLVVSSWEMVKECFTGNNDTAFSNRPIPLAFKTIFYACGGIDSYGLSSVPYGKYWRELRKVCVHNLLSNQQLLKFRHLIISQVDTSFNKLYELCKNSEDNQGNYPTTTTAAGMVRIDDWLAELSFNVIGRIVCGFQSGPKTGAPSRVEQFKEAINEASYFMSTSPVSDNVPMLGWIDQLTGLTRNMKHCGKKLDLVVESIINDHRQKRRFSRTKGGDEKDDEQDDFIDICLSIMEQPQLPGNNNPSQIPIKSIVLDMIGGGTDTTKLTTIWTLSLLLNNPHVLDKAKQEVDAHFRTKRRSTNDAAAAVVDFDDIRNLVYIQAIIKESMRLYPASPVVERLSGEDCVVGGFHVPAGTRLWANVWKMQRDPKVWDDPLVFRPDRFLSDEQKMVDVRGQNYELLPFGAGRRVCPGVSFSLDLMQLVLTRLILEFEMKSPSGKVDMTATPGLMSYKVIPLDILLTHRRIKPCVQSAASERDMESSGVPVITLGSGKVMPVLGMGTFEKVGKGSERERLAILKAIEVGYRYFDTAAAYETEEVLGEAIAEALQLGLVKSRDELFISSMLWCTDAHADRVLLALQNSLRNLKLEYVDLYMLPFPASLKPGKITMDIPEEDICRMDYRSVWAAMEECQNLGFTKSIGVSNFSCKKLQELMATANIPPAVNQVEMSPAFQQKKLREYCNANNILVSAISVLGSNGTPWGSNAVLGSEVLKKIAMAKGKSVAQVSMRWVYEQGASLVVKSFSEERLRENLNIFDWELTKEDHEKIGEIPQCRILSAYFLVSPNGPFKSQEELWDDEA

SEQ ID NO: 324 - DNA, 1473 bp, Papaver rhoeas
atgatcggtctttatcatgttttcatgaataaaaccggcttaattcatgtaactcttggaaacatggctgataaatacggacccattttcagtttcccaacaggtggccatagggctctagttgtgagtagttgggagatggcaaaagagtgttttacaggcgacaatgacattgttttttcaaatcgtcctatgccgttatcgtttaagattatattcaatgcaggtggtatagactcagccggtcttacacaagtaccgtatggaaaatattggagggagttacgaaagatctgtgtgcacaaccttctctcaaatcaacaattactcaagttcaggcacttgataaattctcaagttgatacctctttcactaaactgtacgagtcatgcaacaagggaaattctggcatggtgagaatggatgattggcttggagaattatcattcaacgtgataggaagaatagtctgcggattccgatcagacactgagacaagtgctacaagcagtgcggaacgatttacagtagcaattgatgaagcatcgcgttttatgtccatacctgcagtgtcagatacctttccgtggctaggatggattgatcgattaactggtcttataaaagatatgaagcaccatgcagaaaaattagacttagtggttgaaagcataattgaagatcatcgtcaaaagagacgattttctagaactaaaaaaggagatgagaataacaccgaggatgaacaagatgacttcattgacatttgtttgtcaattatggagcaaccagagcttcctggaaacaactacgctcgtcaaatgcctatcaaatctatcatcgtggacatgataggcggggcgactgacaccacaaaactgaccacaatctggaccctttccttgctgctgaataacccacatgtgttaggcaaggcaaaagaagaagtggatgcacactttggaaagaaaaggagttcaaccaatggggaagtcatggtggattttgatgatattcgtagccttgtctacatccaggcaatcatcaaagaatcaatgcggttgtacccagccagtccagtggtggagcgactgagcagtgaagattgtgtggttggtgggtttcatgtatcagcagggacgcgattatgggttaacgtatggaaggttcaacgagacccagaagtatgggatgatccgtcggtgtttcgaccagagagatttttgagtaatgagcagaagatggttgatgtaaggggtcaagattatgagttgttaccatttggagccggtcgacggatatgtccaggtgtatcgttctctttggatctaatgcacctggtacttactcgtcttattcttgagtttgaaattaagtctcctggtggggaagtggacatgacagcaacacaaggtttaatgagttacaaggtagtcccccttgacattctgctcacccgtcgcatgctttag

SEQ ID NO: 325 - protein, 490 aa, Papaver rhoeas
MIGLYHVFMNKTGLIHVTLGNMADKYGPIFSFPTGGHRALVVSSWEMAKECFTGDNDIVFSNRPMPLSFKIIFNAGGIDSAGLTQVPYGKYWRELRKICVHNLLSNQQLLKFRHLINSQVDTSFTKLYESCNKGNSGMVRMDDWLGELSFNVIGRIVCGFRSDTETSATSSAERFTVAIDEASRFMSIPAVSDTFPWLGWIDRLTGLIKDMKHHAEKLDLVVESIIEDHRQKRRFSRTKKGDENNTEDEQDDFIDICLSIMEQPELPGNNYARQMPIKSIIVDMIGGATDTTKLTTIWTLSLLLNNPHVLGKAKEEVDAHFGKKRSSTNGEVMVDFDDIRSLVYIQAIIKESMRLYPASPVVERLSSEDCVVGGFHVSAGTRLWVNVWKVQRDPEVWDDPSVFRPERFLSNEQKMVDVRGQDYELLPFGAGRRICPGVSFSLDLMHLVLTRLILEFEIKSPGGEVDMTATQGLMSYKVVPLDILLTRRML

SEQ ID NO: 326 - DNA, 981 bp, Papaver rhoeas
atggatagtagtggtgtacctgtaatccctctgagctccggtaaagggatgcctgctttagctctaggaacatttgaaacatttggtaaaggatcgtccgaaagacagagatcggcgtttttgaaagcgatagaggtgggttacagatactttgacacaggtgcttcatacggaaccgaagaggtccttggcgaagctatagatgaagcacttcaacttggccttatcgaatctcgagaggaactgtttatcagttccaatctctggtgtactgatgctcaccctgatcgtgtcctccttgctcttcagaattctctaaggaatcttaaattggagtatctggatctatacatgataccctttccgataagcttgaagcctgggaagataatggaggagataactatggacataccagaggatgaaatgttacctatggactacaagtctgtatgggcagccatggaagagtgtcaggaccttggcttcactaagtcgatcggtgtcagcaatttctcctgcaaaaagcttcaggagttgatggcgaccgccaatatcccaccagctgtgaatcaagtggagatgagccccgttttccaacaaaagaaactgagagagtattgcaaggccaataatatattagtcagcgcagtctcggttttgggatcgaacggaaccgcatggggctccaatcaagttatgggttctgaggtgttgaaacaaattgctactgacagaggaaaatctgttgctcagattagtatgagatgggtttatgagcaaggtgcgagtcttgtggtaaaaagtttcaatgaagtgaggatgagggaaaatttgaacatattcaactggcaacttactaaggaagatttggaaaagatcagcgagattccacaatgcaggatattaactggtgattttttagtttcagctaatggacctttcaaatctctacaagagttatgggatgaccaagtttga

SEQ ID NO: 327 - protein, 326 aa, Papaver rhoeas
MDSSGVPVIPLSSGKGMPALALGTFETFGKGSSERQRSAFLKAIEVGYRYFDTGASYGTEEVLGEAIDEALQLGLIESREELFISSNLWCTDAHPDRVLLALQNSLRNLKLEYLDLYMIPFPISLKPGKIMEEITMDIPEDEMLPMDYKSVWAAMEECQDLGFTKSIGVSNFSCKKLQELMATANIPPAVNQVEMSPVFQQKKLREYCKANNILVSAVSVLGSNGTAWGSNQVMGSEVLKQIATDRGKSVAQISMRWVYEQGASLVVKSFNEVRMRENLNIFNWQLTKEDLEKISEIPQCRILTGDFLVSANGPFKSLQELWDDQV

SEQ ID NO: 328 - DNA, 966 bp, Papaver somniferum
atggagagtaatggtgtacctatgatcactctcagttccggcattcggatgcctgctttaggtatgggaacagctgaaacaatggtaaaaggaacagaaagagagaaattggcgtttttgaaagcgatagaggtcggttacagacacttcgatacagctgctgcataccaaagtgaagagtgtcttggtgaagctatagctgaagcacttcaacttggtctaataaaatctcgagatgaactcttcatcacttccaagctctggtgcgctgatgctcacgctgatcttgtcctccctgctcttcagaattctctgaggaatcttaaattggactatcttgatctatatttgatacaccatccggtaagcttgaagccagggaagtttgttaacgaaataccaaaggatcatatccttccaatggactacaaatctgtatgggcagccatggaagagtgtcagacccttggcttcactagggcaatcggggtctgtaatttctcatgcaaaaagcttcaagagttgatggcagcagccaagatccctccagttgtgaatcaagtggagatgagcccgactttacatcaaaaaaatctgagggaatattgcaaggccaataatatcatgatcactgcacactcggttttgggagccatatgtgctccatggggcagcaatgcagttatggattctaaggtgcttcaccagattgctgtggcaagaggaaaatctgttgcccaggttagtatgagatgggtttaccagcaaggcgcgagtctagtggtgaaaagtttcaatgaagggaggatgaaggaaaaccttaagatatttgattgggaactaacggcagagaatatggaaaagatcagtgagattccgcaatctagaacaagctctgctgatttcttgttatcaccgactggacctttcaaaactgaagaagagttctgggatgagaaggattga

SEQ ID NO: 329 - protein, 321 aa, Papaver somniferum
MESNGVPMITLSSGIRMPALGMGTAETMVKGTEREKLAFLKAIEVGYRHFDTAAAYQSEECLGEAIAEALQLGLIKSRDELFITSKLWCADAHADLVLPALQNSLRNLKLDYLDLYLIHHPVSLKPGKFVNEIPKDHILPMDYKSVWAAMEECQTLGFTRAIGVCNFSCKKLQELMAAAKIPPVVNQVEMSPTLHQKNLREYCKANNIMITAHSVLGAICAPWGSNAVMDSKVLHQIAVARGKSVAQVSMRWVYQQGASLVVKSFNEGRMKENLKIFDWELTAENMEKISEIPQSRTSSADFLLSPTGPFKTEEEFWDEKD

SEQ ID NO: 330 - protein, 321 aa, Papaver somniferum
MESSGVPVITLGSGKVMPVLGMGTFEKVGKGSERERLAILKAIEVGYRYFDTAAAYETEEVLGEAIAEALQLGLVKSRDELFISSMLWCTDAHADRVLLALQNSLRNLKLEYVDLYMLPFPASLKPGKITMDIPEEDICRMDYRSVWAAMEECQNLGFTKSIGVSNFSCKKLQELMATANIPPAVNQVEMSPAFQQKKLREYCNANNILVSAISVLGSNGTPWGSNAVLGSEVLKKIAMAKGKSVAQVSMRWVYEQGASLVVKSFSEERLRENLNIFDWELTKEDHEKIGEIPQCRILSAYFLVSPNGPFKSQEELWDDEA

SEQ ID NO: 331 - DNA, 26 bp, Papaver somniferum
ggatcccatcagttccatgctctggt

SEQ ID NO: 332 - DNA, 26 bp, Papaver somniferum
ggtaccgggctcatctccacttgatt

SEQ ID NO: 333 - DNA, 26 bp, Papaver somniferum
ggatcccatcacttccaagctctggt

SEQ ID NO: 334 - DNA, 25 bp, Papaver somniferum
ggtaccgggctcatctccacttgat

SEQ ID NO: 335 - DNA, 34 bp, Papaver somniferum
gaattccctacatactgtattgggttgaatcatg

SEQ ID NO: 336 - DNA, 25 bp, Papaver somniferum
ggtacctaacgggataggacggttt

SEQ ID NO: 337 - DNA, 1704 bp, Papaver somniferum
atggagctccaatatatttcttattttcaaccaacttcctccgttgttgctcttctacttgctcttgtatccatcttatccagtgtcgttgttttgaggaagacatttttgaataactactcatcatcacctgcatcatccacaaaaacagcggtactttctcatcagcggcagcagtcgtgtgcattgccaatttccggtctcctccatattttcatgaataaaaacggcttaattcatgtaactcttggaaatatggctgataaatacggtccgattttcagtttcccaacaggtagccatagaactctcgttgtgagcagttgggagatggtaaaagagtgttttactggcaacaatgacactgctttctcaaaccgtcctatcccgttagcttttaagactatattctatgcatgcggtggcatagactcatacggtctttcgagtgtaccttatggaaaatattggagggagcttcgaaaggtctgtgtgcataacctcctgtctaatcaacaactactcaagttcagacacttgataatttctcaagtcgatacgtctttcaataagctgtatgagttatgcaaaaactctgaagacaaccagggaaactatcctactactactaccgcagctggcatggtgagaatcgatgattggctcgccgaattatcgttcaatgtgataggaagaatagtctgcggattccaatcaggccctaagacaggtgctccaagcagggtggaacaatttaaagaagcaattaatgaagcatcttattttatgtcgacatctccagtgtcagataatgttccaatgctagggtggattgaccaattgacaggtcttacgagaaatatgaagcactgcggaaagaaattagacttggtggtcgagagcataattaatgatcatcgtcaaaagagacgattctctagaactaaaggaggagatgagaaggacgatgaacaagatgacttcatcgacatttgtttgtcaataatggagcaaccacagcttcctggcaacaataatccttctcagatacctatcaaatctattgtcctggacatgataggtgggggcactgacaccacaaaactgaccaccatctggaccctttccttgctgctgaacaacccccatgtgttggacaaggcaaaacaagaagtggatgcacactttcgaaccaaaaggagatcaacaaatgatgcagcagcagccgtggtggattttgatgatattcgtaaccttgtctacatccaggcaatcatcaaagaatcaatgcggttgtatccagccagccccgtggtggagcgactgagcggcgaagattgtgtggtcggtgggtttcatgtaccagcagggacgagattatgggctaacgtatggaagatgcaacgagaccctaaagtatgggatgatccattggtgtttcgaccagacagatttttgagcgatgaacagaagatggttgatgtaaggggtcaaaattatgagctgttaccatttggagccggtcgacgtgtatgtccaggtgtatccttctctttggatctaatgcaactggtactgactcgtcttattctcgagtttgaaatgaagtctcctagcgggaaagtggacatgacagcaacaccaggattaatgagttacaaggtgatcccccttgacattctgctcacccatcgtcgcataaag

SEQ ID NO: 338 - protein, 568 aa, Papaver somniferum
MELQYISYFQPTSSVVALLLALVSILSSVVVLRKTFLNNYSSSPASSTKTAVLSHQRQQSCALPISGLLHIFMNKNGLIHVTLGNMADKYGPIFSFPTGSHRTLVVSSWEMVKECFTGNNDTAFSNRPIPLAFKTIFYACGGIDSYGLSSVPYGKYWRELRKVCVHNLLSNQQLLKFRHLIISQVDTSFNKLYELCKNSEDNQGNYPTTTTAAGMVRIDDWLAELSFNVIGRIVCGFQSGPKTGAPSRVEQFKEAINEASYFMSTSPVSDNVPMLGWIDQLTGLTRNMKHCGKKLDLVVESIINDHRQKRRFSRTKGGDEKDDEQDDFIDICLSIMEQPQLPGNNNPSQIPIKSIVLDMIGGGTDTTKLTTIWTLSLLLNNPHVLDKAKQEVDAHFRTKRRSTNDAAAAVVDFDDIRNLVYIQAIIKESMRLYPASPVVERLSGEDCVVGGFHVPAGTRLWANVWKMQRDPKVWDDPLVFRPDRFLSDEQKMVDVRGQNYELLPFGAGRRVCPGVSFSLDLMQLVLTRLILEFEMKSPSGKVDMTATPGLMSYKVIPLDILLTHRRIK

SEQ ID NO: 339 - DNA, 966 bp, Papaver somniferum; identical to SEQ ID NO: 1

SEQ ID NO: 340 - protein, 321 aa, Papaver somniferum; identical to SEQ ID NO: 330

SEQ ID NO: 341 - DNA, 966 bp, Papaver somniferum
atggagagtagtggtgtaccagtaatcactctgggctcgggcaaggtgatgcctgttctgggcatgggaacatttgagaaagttggtaaagggtccgaaagagagaggttggcgattttaaaagcgatagaggtgggttacagatacttcgatacagctgctgcatacgaaactgaagaggttcttggagaagctattgctgaagcacttcaacttggcctagtcaaatctcgagatgaacttttcatcagttccatgctctggtgcactgatgctcacgctgatcgtgtcctcctcgctcttcagaattcgctgaggaatcttaaattggagtatgtggatctatatatgttacccttcccggcaagcttgaagcctgggaagataacgatggacataccagaggaagatatttgtcgcatggactacaggtctgtatgggcagccatggaagagtgtcaaaaccttggcttcactaaatcaatcggtgttagcaatttctcctgcaaaaagcttcaggaattgatggcgaccgccaacatccctccagctgtgaatcaagtggagatgagcccggctttccaacaaaagaagctgagagagtattgcaacgcaaataatatattagtcagtgcaatctctgtactgggatcaaacggaaccccatggggctccaatgcagttttgggttctgaggtgcttaagaaaattgctatggccaaaggaaaatctgttgctcaggttagtatgagatgggtttacgagcaaggcgcgagtcttgtggtaaaaagtttcagtgaagagagattgagggaaaacttgaacatatttgactgggaactcactaaggaagaccatgaaaagatcggtgagattccacagtgcagaatcttgagtgcttattttttggtctcacctaatggacctttcaaatctcaagaagagttgtgggatgatgaagcttga

The invention claimed is:

1. A method for preparing (R)-Reticuline or an (R)-Reticuline precursor, the method comprising:
   (a) introducing into a non-plant cell a chimeric nucleic acid sequence that encodes a polypeptide haying an amino acid sequence that corresponds to at least 85% of the sequence identity to the polypeptide encoded by SEQ ID NO: 322, comprising as operably linked components:
      (i) a first nucleic acid sequence encoding CYP450;
      (ii) a second nucleic acid sequence encoding AKR; and
      (iii) one or more nucleic acid sequence capable of controlling expression in a host cell;
   (b) growing the host cell to produce CYP450, AKR, and (R)-Reticuline or the (R)-Reticuline precursor.

2. The method of claim 1, wherein the non-plant cell is a yeast cell.

3. The method of claim 1, wherein the non-plant cell is a bacteria cell.

4. The method of claim 1, wherein the chimeric nucleic acid sequence that encodes a polypeptide having an amino acid sequence that corresponds to at least 90% of the sequence identity to the polypeptide encoded by SEQ ID NO: 322.

5. The method of claim 1, wherein the chimeric nucleic acid sequence that encodes a polypeptide having an amino acid sequence that corresponds to at least 95% of the sequence identity to the polypeptide encoded by SEQ ID NO: 322.

6. The method of claim 1, wherein the host cell produces (S)-Reticuline.

7. The method of claim 1, wherein the host cell produces (R)-Reticuline.

8. The method of claim 1, wherein the host cell produces at least one compound selected from the group consisting of (S)-Coclaurine, (S)-N-Methylcoclaurine, (S)-3'-Hydroxy-N-methylcoclaurine, (R)-N-Methylcoclaurine, (R)-3'-Hydroxy-N-methylcoclaurine, and (S)-Reticuline.

9. The method of claim 1, wherein the host cell produces at least one (R)-Reticuline precursor selected from the group consisting of (R)-N-Methylcoclaurine or (R)-3'-Hydroxy-N-methylcoclaurine.

10. The method of claim 1, wherein growing the host cell comprises:
   culturing the host cell in a cellular growth medium, wherein the cellular growth medium comprises at least one of (S)-Norcoclaurine, (S)--N-Methylnorcoclaurine, (S)-Norlaudanosaline, (S)--N-Methylnorlaudanosaline, (S)-Coclaurine, (S)-N-Methylcoclaurine, (S)-3'-Hydroxycoclaurine, (S)-3'-Hydroxy-N-methylcoclaurine, (S)-Higenamine, (S)--N -Methylhigenamine, (S)-Laudanosoline, (S)-Norreticuline, and (S)-Orientaline.

\* \* \* \* \*